United States Patent 8,586,006 (ORGAN-SPECIFIC PROTEINS AND METHODS OF THEIR USE) - sequence listing, part 21

SEQ ID NO: 65547 - DNA, 1408 bp, Homo sapiens
ccctgaagttagttccacacccgaaacccaagccctctggccacttctgcccaggaaatgagagagggcatgcgattcccttggccatgtggccccagctgacatgagactggtcagggatgaaggtgagcaggaaggccctgcctgtgaaattcctggctgagctgattgctgccattgctctagtaggaagtcttgttcctggagcagtgagtattttgtgtctagaatctgatgtggcaaaccaaacatactgcagtttggagcacttggcatcataaaggaagagttctgggcagtgggtgagaaggaattaagggagtggacaccctaagccaccaaagcttccctcctaatgcttccctggctgaagcacaggctccttcccacatctccctccctctaaaagccccagaacccaaccacacagatccgtccatcactcagagatggacaggaaaggtgaggcaggattgttgatggctgctgtcttgcccagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65548 - DNA, 1060 bp, Homo sapiens
tttttgagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65549 - DNA, 1919 bp, Homo sapiens
ccacgctccctaatctatctttggcgcaggggaggcttcttattcctgtttatggatcgggatgcttaggctccaggacatggagcagcctgtctgagaccacccagctaaggagggagagctgagacagggcttccccgtcacagcacttgccctcaatgttcatcactgaagcatgtgattttctcatcacatcctcccacttcaagtggggcagggcagtgaggtccttcctgaggctcaggcatcttgagaaaagaaggtgtggacagagcagaaggtcatggcagagcactccagcaggcagaggtttctgtccacagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggcaccaagtgcaaagccaaggagctcaaagccaccacgatcctccacacgggggagttatcttacccaaacctgtcgtggatcagaaaggttttagttctcggaggtgaaattgagtctgggaaagggacgctgcatctccagagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65550 - DNA, 1738 bp, Homo sapiens
ccacgctccctaatctatctttggcgcaggggaggcttcttattcctgtttatggatcgggatgcttaggctccaggacatggagcagcctgtctgagaccacccagctaaggagggagagctgagacagggcttccccgtcacagcacttgccctcaatgttcatcactgaagcatgtgattttctcatcacatcctcccacttcaagtggggcagggcagtgaggtccttcctgaggctcaggcatcttgagaaaagaaggtgtggacagagcagaaggtcatggcagagcactccagcaggcagaggtttctgtccacagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65551 - DNA, 1455 bp, Homo sapiens
tcctggtgtgcctcctgcaggtgtcacagcctaggctcttgggagtgccttggtttgggagtcccaacagctccaccccagggagcagcccttgaatagcgccacaagagtcaggggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65552 - DNA, 1693 bp, Homo sapiens
gcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctaccaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcagacagatgcctcagcatgaagggcttggggacttgtggatcattccttcctccctgcaggagcttcccaagctggtcacagagtctcctgggcacagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattc

SEQ ID NO: 65553 - DNA, 1865 bp, Homo sapiens
gcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctaccaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattc

SEQ ID NO: 65554 - DNA, 1857 bp, Homo sapiens
gcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctaccaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65555 - DNA, 1699 bp, Homo sapiens
aggagcacgtttctctccgtgtaaccggtaaagatactgatgctaagagaagctaaggagctggcccaagaaacccagccagcacgtggcaaggcccacgcagaatccagcccaagcccctggacccagccaccactccgctgcctgcactcagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65556 - DNA, 1834 bp, Homo sapiens
ccacgctccctaatctatctttggcgcaggggaggcttcttattcctgtttatggatcgggatgcttaggctccaggacatggagcagcctgtctgagaccacccagctaaggagggagagctgagacagggcttccccgtcacagcacttgccctcaatgttcatcactgaagcatgtgattttctcatcacatcctcccacttcaagtggggcagggcagtgaggtccttcctgaggctcaggcatcttgagaaaagaaggtgtggacagagcagaaggtcatggcagagcactccagcaggcagaggtttctgtccacagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65557 - DNA, 2497 bp, Homo sapiens
gacagcttccggcaactgatgcctccactggccactcctccctccgtccacctgtcacttcgggtagctgggaggccagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattataaaaaaaaaaaaaaaaaaaaaaaaaaaaaa

SEQ ID NO: 65558 - DNA, 5189 bp, Homo sapiens
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgctgggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctctttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtgcagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccatggacctgggccagctctgtgagggctttacccttccacccgaaggacatcatgggggcattcagccactcagaaatgcagatgattaaccaatattgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacggcatttaaagttgtataaaaacacgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttattttagactcaaagaatataatcttgcactactcagttattactgtttgttctcttattccctagtctgtgtggcaaattaaacaatataagaaggaaaaatttgaagtattagacttctaaataaggggtgaaatcatcagaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattccccaaaaaaaaaaaaaaaa

SEQ ID NO: 65559 - protein, 538 aa, Homo sapiens
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 65560 - protein, 514 aa, Homo sapiens
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 65561 - protein, 538 aa, Homo sapiens; identical to SEQ ID NO: 65559

SEQ ID NO: 65562 - protein, 538 aa, Homo sapiens; identical to SEQ ID NO: 65559

SEQ ID NO: 65563 - protein, 543 aa, Homo sapiens
MRYKEMVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 65564 - protein, 126 aa, Homo sapiens
MPEPAKSAPAPKKGSKKAVTKAQKKDGRKRKRSRKESYSVYVYKVLKQVHPDTGISSKAMGIMNSFVNDIFERIAGEASRLPHYNKRSTITSREIQTAVRLLLPGELAKHAVSEGTKAVTKYTSAK

SEQ ID NO: 65565 - protein, 126 aa, Homo sapiens
MPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 65566 - protein, 126 aa, Homo sapiens; identical to SEQ ID NO: 65565

SEQ ID NO: 65567 - protein, 126 aa, Homo sapiens [sequence omitted]

SEQ ID NO: 65568 - protein, 126 aa, Homo sapiens
MPEPVKSAPVPKKGSKKAINKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 65569 - protein, 126 aa, Homo sapiens
MPEPSKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 65570 - protein, 126 aa, Homo sapiens
MPDPAKSAPAPKKGSKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 65571 - protein, 210 aa, Homo sapiens
MSRAGSHPKPAIPGRGGEKLALLLAMLGGRCCPAGGPESHTPRKPWPPIRRERPGLRSPKPREEAGPRADSKAASPALFMGPGSRGRRRPPSWARRRARGGRGSCPEPHVRAGPRFFIALAAQAARGLRVSSQGPGLWRGPAARKEGVARVGVAAGLRLRPRGRGRKTTPALSGHPARFPLQPGDSRERSRNHRALELTWQPRGAKAGGA

SEQ ID NO: 65572 - protein, 210 aa, Homo sapiens; identical to SEQ ID NO: 65571

SEQ ID NO: 65573 - protein, 152 aa, Homo sapiens
MSWAGSHPTPTIPGRGGERLALLLAMLGGRCCPAGGPESHTPRKPWPPTRRERPGLRSPKPREEAGPRADSKAASPALFMGPGSRGRRRPPSWARRRARGGRGSCPEPHVRAGPASSSHLRPRLPGACEFPARARDSGAVRPRGRKARPGWG

SEQ ID NO: 65574 - protein, 152 aa, Homo sapiens; identical to SEQ ID NO: 65573

SEQ ID NO: 65575 - protein, 193 aa, Homo sapiens
MPEPAKFAPAPKKGSKKAVTKAQKKDGKKRKRSRKESYSIYVYKVLKRVHPDTGIWCKAMGIMNSFLNDIFERIAGEASRLAHYNKRSTITSRRSRRPCACCCPASWPSTPCPRAPRRSPSTPAPSESLPGPGARSLPPSLPPRVAGCFVSKGSFQGHLTTSVKESFLCCQSQLMFLASRLVNFRRAHNTKHR

SEQ ID NO: 65576 - protein, 117 aa, Homo sapiens
MKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMVSRHSQC

SEQ ID NO: 65577 - protein, 327 aa, Homo sapiens
MAWWKSWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 65578 - protein, 315 aa, Homo sapiens
MAWWKSWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMVSRHSQC

SEQ ID NO: 65579 - protein, 48 aa, Homo sapiens
MKGAGTRDGTLIRNIVSRSEIDLNLIKCHFKKMYGKTLSSMIMEWNCL

SEQ ID NO: 65580 - protein, 30 aa, Homo sapiens [sequence omitted]

SEQ ID NO: 65581 - protein, 62 aa, Homo sapiens [sequence omitted]

SEQ ID NO: 65582 - protein, 30 aa, Homo sapiens [sequence omitted]

SEQ ID NO: 65583 - protein, 276 aa, Homo sapiens
MAWWKSWIEQEGVTVKSSSHFNPDPDAETLYKAMKGIGVGSQLLSHQAAAFAFPSSALTSVSPWGQQGHLCCNPAGTNEQAIIDVLTKRSNTQRQQIAKSFKAQFGKDLTETLKSELSGKFERLIVALMYPPYRYEAKELHDAMKGSRDDVSSFVDPGLALQDAQDLYAAGEKIRGTDEMKFITILCTRSATHLLRVKCTQNLHSYFAERLYYAMKGAGTRDGTLIRNIVSRSEIDLNLIKCHFKKMYGKTLSSMIMEDTSGDYKNALLSLVGSDP

SEQ ID NO: 65584 - protein, 164 aa, Homo sapiens
MKAYEEDYGSSLEEDIQADTSGYLERILVCLLQGSRDDVSSFVDPGLALQDAQDLYAAGEKIRGTDEMKFITILCTRSATHLLRVKCTQNLHSYFAERLYYAMKGAGTRDGTLIRNIVSRSEIDLNLIKCHFKKMYGKTLSSMIMEDTSGDYKNALLSLVGSDP

SEQ ID NO: 65585 - protein, 327 aa, Homo sapiens; identical to SEQ ID NO: 65577

SEQ ID NO: 65586 - protein, 129 aa, Homo sapiens [sequence omitted]

SEQ ID NO: 65587 - protein, 327 aa, Homo sapiens; identical to SEQ ID NO: 65577

SEQ ID NO: 65588 - protein, 327 aa, Homo sapiens; identical to SEQ ID NO: 65577

SEQ ID NO: 65589 - protein, 327 aa, Homo sapiens; identical to SEQ ID NO: 65577

SEQ ID NO: 65590 - protein, 222 aa, Homo sapiens [sequence omitted]

SEQ ID NO: 65591 - protein, 196 aa, Homo sapiens [sequence omitted]

SEQ ID NO: 65592 - protein, 327 aa, Homo sapiens [sequence omitted]

SEQ ID NO: 65593 - protein, 315 aa, Homo sapiens
MAWWKSWIEQEGVTVKSSSHFNPDPDAETLYQAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMVSRHSQC

SEQ ID NO: 65594 - protein, 145 aa, Homo sapiens
MSLQEDVRQDPQQHDHGRHQRRLQERPAEPGGQRPLRHRRTRAKTMKPESPGLLTQPRPWTQVISQCEHNANLSVSPARQMPQHEGLGDLWIIPSSLQELPKLVTESPGHSRRAGWEPFCFRTHILQQLRNEHESIPTEMPLTFI

SEQ ID NO: 65595 - protein, 158 aa, Homo sapiens
MSLQEDVRQDPQQHDHGRHQRRLQERPAEPGGQRPLRHRRTRAKTMKPESPGLLTQPRPWTQVISQCEHNANLSVSPARQMPQHEGLGDLWIIPSSLQELPKLVTESPGHRLYRPQPHSHLLKQGLHKRGQGIWVFNKRLTKHFSIMQPESWLGALLF

SEQ ID NO: 65596 - protein, 62 aa, Homo sapiens [sequence omitted]

SEQ ID NO: 65597 - protein, 226 aa, Homo sapiens
MFITEACDFLITSSHFKWGRAVRSFLRLRHLEKRRCGQSRRSWQSTPAGRGFCPQGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVAPSAKPRSSKPPRSSTRGSYLTQTCRGSERF

SEQ ID NO: 65598 - protein, 243 aa, Homo sapiens
MFITEACDFLITSSHFKWGRAVRSFLRLRHLEKRRCGQSRRSWQSTPAGRGFCPQGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVKCTQNLHSYFAERLYYAMKGAGTRDGTLIRNIVSRSEIDLNLIKCHFKKMYGKTLSSMIMEDTSGDYKNALLSLVGSDP

SEQ ID NO: 65599 - protein, 129 aa, Homo sapiens [sequence omitted]

SEQ ID NO: 65600 - protein, 327 aa, Homo sapiens [sequence omitted]

SEQ ID NO: 65601 - protein, 327 aa, Homo sapiens [sequence omitted]

SEQ ID NO: 65602 - protein, 327 aa, Homo sapiens [sequence omitted]

SEQ ID NO: 65603 - protein, 222 aa, Homo sapiens [sequence omitted]

SEQ ID NO: 65604 - protein, 275 aa, Homo sapiens
MFITEACDFLITSSHFKWGRAVRSFLRLRHLEKRRCGQSRRSWQSTPAGRGFCPQGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 65605 - protein, 424 aa, Homo sapiens
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKRKGWWDGKKEFDFAAAYSYLDTAKMMTSSGRYCEGYKLLNKHKGNITFETMMEILRDKPSGINMEGEFLTTASMVSILPQDSSLPCIHFFTGTPDPERSVFKPFIFVPHISQLLDTSSPTFELEDLVKKKSHFKPDRRHPLYQKHQQALEVVNNNEEKAKIMLDNMRKLEKELFREMESILQNKHLDVEKIVNLFPQCTKDEIQIYQSNLSVKVSS

SEQ ID NO: 65606 - protein, 751 aa, Homo sapiens
MAFRTICVLVGVFICSICVKGSSQPQARVYLTFDELRETKTSEYFSLSHHPLDYRILLMDEDQDRIYVGSKDHILSLNINNISQEALSVFWPASTIKVEECKMAGKDPTHGCGNFVRVIQTFNRTHLYVCGSGAFSPVCTYLNRGRRSEDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTCPGGAFTPNMRTTKEFPDDVVTFIRNHPLMYNSIYPIHKRPLIVRIGTDYKYTKIAVDRVNAADGRYHVLFLGTDRGTVQKVVVLPTNNSVSGELILEELEVFKNHAPITTMKISSKKQQLYVSSNEGVSQVSLHRCHIYGTACADCCLARDPYCAWDGHSCSRFYPTGKRRSRRQDVRHGNPLTQCRGFNLKAYRNAAEIVQYGVKNNTTFLECAPKSPQASIKWLLQKDKDRRKEVKLNERIIATSQGLLIRSVQGSDQGLYHCIATENSFKQTIAKINFKVLDSEMVAVVTDKWSPWTWASSVRALPFHPKDIMGAFSHSEMQMINQYCKDTRQQHQQGDESQKMRGDYGKLKALINSRKSRNRRNQLPES

SEQ ID NO: 65607 - DNA, 20 bp, Homo sapiens
gatcatgctgctgagggtct

SEQ ID NO: 65608 - DNA, 20 bp, Homo sapiens
gatccattgactgtgatttc

SEQ ID NO: 65609 - DNA, 20 bp, Homo sapiens
gatcctactggattatgaag

SEQ ID NO: 65610 - DNA, 20 bp, Homo sapiens
gatcatggttcatgttactg

SEQ ID NO: 65611 - DNA, 20 bp, Homo sapiens
gatcagcagcatctccacct

SEQ ID NO: 65612 - DNA, 20 bp, Homo sapiens
gatcattgcaccattgcact

SEQ ID NO: 65613 - DNA, 20 bp, Homo sapiens
gatccagacggccgtgcgcc

SEQ ID NO: 65614 - DNA, 20 bp, Homo sapiens
gatcacctttccatttctaa

SEQ ID NO: 65615 - DNA, 20 bp, Homo sapiens
gatctattaagggattagta

SEQ ID NO: 65616 - DNA, 20 bp, Homo sapiens
gatcctggtcattccccaca

SEQ ID NO: 65617 - DNA, 20 bp, Homo sapiens
gatcaatgttaataacaaat

SEQ ID NO: 65618 - DNA, 20 bp, Homo sapiens
gatcagtggtcagtaatctt

SEQ ID NO: 65619 - DNA, 20 bp, Homo sapiens
gatcaaattttgagcaaaga

SEQ ID NO: 65620 - DNA, 20 bp, Homo sapiens
gatctttctgacttttcaaa

SEQ ID NO: 65621 - DNA, 20 bp, Homo sapiens
gatcaaggcaggaaaatgag

SEQ ID NO: 65622 - DNA, 20 bp, Homo sapiens
gatctactcaaaggtttgat

SEQ ID NO: 65623 - DNA, 3398 bp, Homo sapiens
ccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgtaaaaaaaaaaaaaaaa

SEQ ID NO: 65624 - DNA, 3284 bp, Homo sapiens
ccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgtaaaaaaaaaaaaaaaa

SEQ ID NO: 65625 - DNA, 3142 bp, Homo sapiens
gagtgtttttcttcagttgtgcctcttcctctctaacaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgta

SEQ ID NO: 65626 - DNA, 1110 bp, Homo sapiens
gactccataaccgtggccttggccccagtccccctgacttccggacttcagaccagatactgcccatatccccttatgaagtcttggccaggcaacccctagggtgtacgttttctaaagattaaagaggcggtgctaagctgcagacggacttgcgactcagccactggtgtaagtcaggcgggaggtggcgcccaataagctcaagagaggaggcgggttctggaaaaaggccaatagcctgtgaaggcgagtctagcagcaaccaatagctatgagcgagaggcgggactctgagggaagtcaatcgctgccgcaggtaccgccaatggcttttggcgggggcgttccccaaccctgccctctctcatgaccccgctccgggattatggccgggactgggctgctggcgctgcggacgctgccagggcccagctgggtgcgaggctcgggcccttccgtgctgagccgcctgcaggacgcggccgtggtgcggcctggcttcctgagcacggcagaggaggagacgctgagccgagaactggagcccgagctgcgccgccgccgctacgaatacgatcactgggacgcggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggctggtgcacacccaggagccgggggagtggctggaactcttgctggagccgggctccctctacatccttaggggctcagcccgttatgacttctcccatgagatccttcgggatgaagagtccttctttggggaacgccggattccccggggccggcgcatctccgtgatctgccgctccctccctgagggcatggggccaggggagtctggacagccgcccccagcctgctgacccccagctttctacagacaccagatttgtgaataaagttggggaatggacagcct

SEQ ID NO: 65627 - DNA, 1332 bp, Homo sapiens
cggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtaacctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcactttggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttttgaagcgatgagagaaatgcccgtattaggaggattacttgagccctggaggtcaaagctgaggtgagccatgattactccactgcactccagcctgggcaacagagccaggccctgtatcaaaaaaaaaaaaaaaaaaaaaaaaaaaa

SEQ ID NO: 65628 - DNA, 5317 bp, Homo sapiens
atgacccggatgtcctgcccctggggttcctaccagtgggagccgggggcatgtcctgcagccccaagaggcataggtggtggggacatggctgggggtatcccagatgtgcgggggctccaggaggcagctctaggtgcgggaaggagccaagaggaggcacgcctggtggaggaagcccagaccccagtgatgctgccacaggattcggggcagagggtggaggaggttcccggggacctgatggccaagagaatgtcgctcatcttgcacgtgcaaaagttgccctgggaccacgtgccttgcctgcggaggacccggcaaaacctgtaccaggacgtcggtggccacgcccacggctcagggctgggcggggccaagcgcggggcagcacgctctgctctccgacgtcccctcccgcccgcgacctgccgacctgcggggatcgttagcggtcccagcccccgtctagattcaaatccgactggggcccatctgattaaacagaccaggccactcactgtggagtggaccaaggatactcctgtccctgagcccatggagctaaggtctgatgccagccacaaggagaatgtgtccccaaagcctgcagcgctcccgaagccaggcaagaggcttaagcaacgaagattccggaggagcctgggcatcggcctgagtggtagacatgaccagtgggtgcccgggtgccaggtggagaggggagggcctgctgccacaccctccccaggggcagtgctagaccaggagccctgccgagtccagaccaacctggccagccctggtccccgcctgggcctagctctgaaggacacgactggccaactggtcaattcaagcttctggcaacagagcaacctgcagtccctggccaggaggcgccaagggaaggcccgagagtttgccatccagcagagcaacctgagcatcaacgagaccagcagcccccacctctgcccagagcctgggggaagctctgggccccacaagcttccctggggtcctctcctatcccaagagccactggctcgcccatcttcctgcctgaggcagtccgggctgccggccccaggcacccctagcggggacttcaggcccactgaagcctttgcccctctcgatgggcatacacagccaggcctcagatcctggggtggtctggggagctggaggtccaggctggtgggggaacctctcaccctggaggacctggctgtccccagtcagaaccagactcaggccccatcccgtgctgccgtccaccagctgctggcttctgtacattgcctggcgcaggaggcagcccgactcagctggcagctgttgtccagatgttttcgatcctggaggcacttggtgaagaggcagcgggagccagcggcggcggcagtggcactgggccgctggcagctgttgcgaaagtgccttcaggccttgtggctccgggaggctcagctggaggcagcatgggggcagtacacaaaggttctgctggtccggagcttccgagaggtcagcggtctccaggttgggccagggggccgtgtgaagcagtgtccaggaagtctgagggaggaggagattgctcagcggcttctgtcacatcctaggcagagaacagacagcagacacgagagagtccagatcctgcaggccctgcaactggctgtgttcttcctgtggtgccaacagaagaaacgggccagacaggagagggagactctgcggaaggccaccagggccacacagaggacagggagcttcccccaggcctggcactctactgctgcaggtgtagcctgggtggccccactgagcccccagcaccagagagcttggctgtgcaggtgcttcggggcgtggcagcagttcgtgcaaagagggtcccggtaccgagaccacctggctgaccgccggacggggaccctgaggaaatgcctggaacagtgggtgcggatgaagcagctccgggaatcagatggggcaaaggtgacccagctgtccctctgccggcagaaagcaggacgtgaggctgtctacaccgcaggccctggagcctgtggcctgggtgcagtgggccaggcccaggggcagcaggagcaaggccggggctccctgcaggatgcctgctggacactggccctctgctgggcgctgctgctgtggaagatgcggcttttccagcgccagtgggccaactccttcttccagggcctgcagcagcggatgctgcagcgcagcctgagatggtggcacttgagggcactgggcccagatgccacatcaagctgcaccaagaccccctcggctctggagccactgagcagcagcacactccaagactctctggagaaggttcccagggcccccaccctcccggacactctccaggggagccttctgtgggcagctgggcagcggcagcaggggcagtgccttctgctctggcaggcacgggcccagcagttccagggcacagccaggtggtaccagcatacccgccagaggcgcatcttcctcagctggagccgctgggcaacagcccaatgggcctggagagagctggcttcccaccgggcctgggatcggacctgcagggctgtgctgggcctgtggcgtcagcggctgctgcagtcacggctggtggagtggtgggcccaggagcggggctggcggctggcacgagatgccctatgccactggcactcctgttggcaggggcagcagttcctgcatgaaaagtgccagacatgggtgcaggtccacctccagggcctgcagaaggtggtgttccggagctggcagcaggcagcagctcatcagagatgcacagtgacccggccagagcagctgctactgcagagctacttccaggcctggtgtgaggttgtaagagacacgggggtgctccgggcccagcatcaagcctttcaggatggcctgaggagaagagcactgggggccgtgtttgccacatggcgggaagcccaggaagtggcagccggggcacaggagcagcgtgtggcccaggcctcccttgcccgctggagaagctgcgggcagcaaggccaggaagatgggcagcagaagaaggcccgggccccacaggccttcccagcatggccagtggccccgggcatgcaccatgaggcccagcagcaggcaggagagagcgctggggcccaggcagcccagtgctggacttggtgctgggctctgtgggtgcatgagtcctgtcggggccaggtcagccgagcccatgcttcctggaagccgcgagcctgggtcctagaggcctcggtgcagtcggcggtgcgcggcggtgtccagcgagccatcctcacccagctccggccggctgagctcaggcgcttcctgcggacagtgcagctcagggtgcggctgggactgccaggggccggcaagacccgcagctgctggacacaggccacagagctggtgcctcccgcgccatcactgcagtgcagcctgggtggacggaggaagccaaggggaacggcctgggctcagaggtgcagggaacattccctctgccctgccttccagctctggccacagtggcctggacagagtagctgggtcccaggcctgcccctgtggacgagggaccagggaccaagagcgcactccagccctgagcccagagcctgcaaagcccaaagcaaggcccataaacggaggctacggatcctggaaaagcaggcccaggcccatggctctgccctccttctggccctgaagggtcacgatgctcttggccatcaggaggaagtacctgcagcgccggtgcctcgaggcactgcttcacgggctgcggggttcccagcaggccaggtgcctggcagtggcatggcagcactgggtggatgcccaaggggcagagcagctggtgcggaccctgctcagggagtggcacctgagatgggcctggcagacgtggtggcagcggatcctgcgactgcgagtggctcagcagttacagcagcaggaagatgggcctttaagaagtggcaccaacgcctggcagccaggagcccaaggagaggagctgccagtagcccaagaccctggagcaagccaggccccaagggccccgagagtggacaggaagccgccagagcaccgcggggttgggggcttggggcagagcatggggcccagctgcagctgtgacttgttctcatagaataaaaaacagaactgaacttagccttcccagggaaggaaccatgccccacacatccagggagtgatgacagaggggacagcttgaagagctctgaaggacaataaaacccactcctcagtcctagctgctgctttcagtctctcctagcggctgcccctctgccccagccagtgaggccaggaagggagtaaagaggacatcccacaattgcgtccacccccttggccatcaggctgctcttccactacacgaaacagcccatctgcacctgccagtcactgcccccaggccctggggcttgcaggtgactcgtggggagccaggccaggcagataacctctgggacaggacgaggggatgaggaaggcagctggcaggacaagggcctacctgaaaaatacaccaggaagctgggctgctgcacaggcccaggcagatctggggcccctgtgctggcaaatctcatcttagcctctgacagggaacggggcagcatcaggcctccacagccaggcaaaaggggaaggccacgagccccaccaagcacaagggttcagactgccttcaacccttaaggggcactttttctctcaaggctcagaatagacaactgtgccaaaaagcagcatggtaggtgtcagcccaatgcccatccagggggctggtgccatggacggctaagtgggcaggcagggcagtggtgtgccccttcagtcacaagtaggtggggcccagctgcccacctctaggaggtggaagggtacagcactttgccacatctcttctacgatgccaccagtgcctgatgcccttgcgtgttttgcctgtactgcacgggctccaagtgtaagttcactgggagtcccaggctggctctggaggctgccttggttcgagggcttagttggcaacaaccactctcctcgccttctcaggaggtgccacccactgtggtcctctgcaggacgcaagtgctccccaccaaaagagcacagactcctggctagagcagagagtactaggttcccatgtggggccgactcaggtccaggaagagcctggaagcctcactccagtctagctgcc

SEQ ID NO: 65629 - DNA, 5317 bp, Homo sapiens
atgacccggatgtcctgcccctggggttcctaccagtgggagccgggggcatgtcctgcagccccaagaggcataggtggtggggacatggctgggggtatcccagatgtgcgggggctccaggaggcagctctaggtgcgggaaggagccaagaggaggcacgcctggtggaggaagcccagaccccagtgatgctgccacaggattcggggcagagggtggaggaggttcccggggacctgatggccaagagaatgtcgctcatcttgcacgtgcaaaagttgccctgggaccacgtgccttgcctgcggaggacccggcaaaacctgtaccaggacgtcggtggccacgcccacggctcagggctgggcggggccaagcgcggggcagcacgctctgctctccgacgtcccctcccgcccgcgacctgccgacctgcggggatcgttagcggtcccagcccccgtctagattcaaatccgactggggcccatctgattaaacagaccaggccactcactgtggagtggaccaaggatactcctgtccctgagcccatggagctaaggtctgatgccagccacaaggagaatgtgtccccaaagcctgcagcgctcccgaagccaggcaagaggcttaagcaacgaagattccggaggagcctgggcatcggcctgagtggtagacatgaccagtgggtgcccgggtgccaggtggagaggggagggcctgctgccacaccctccccaggggcagtgctagaccaggagccctgccgagtccagaccaacctggccagccctggtccccgcctgggcctagctctgaaggacacgactggccaactggtcaattcaagcttctggcaacagagcaacctgcagtccctggccaggaggcgccaagggaaggcccgagagtttgccatccagcagagcaacctgagcatcaacgagaccagcagcccccacctctgcccagagcctgggggaagctctgggccccacaagcttccctggggtcctctcctatcccaagagccactggctcgcccatcttcctgcctgaggcagtccgggctgccggccccaggcacccctagcggggacttcaggcccactgaagcctttgcccctctcgatgggcatacacagccaggcctcagatcctggggtggtctggggagctggaggtccaggctggtgggggaacctctcaccctggaggacctggctgtccccagtcagaaccagactcaggccccatcccgtgctgccgtccaccagctgctggcttctgtacattgcctggcgcaggaggcagcccgactcagctggcagctgttgtccagatgttttcgatcctggaggcacttggtgaagaggcagcgggagccagcggcggcggcagtggcactgggccgctggcagctgttgcaaaagtgccttcaggccttgtggctccgggaggctcagctggaggcagcatgggggcagtacacaaaggttctgctggtccagagcttccgagaggtcagcggtctccaggttgggccagggggccgtgtgaagcagtgtccaggaagtctgagggaggaggagattgctcagcggcttctgtcacatcctaggcagagaacagacagcagacacgagagagtccagatcctgcaggccctgcaactggctgtgttcttcctgtggtgccaacagaagaaacgggccagacaggagagggagactctgcggaaggccaccagggccacacagaggacagggagcttcccccaggcctggcactctactgctgcaggtgtagcctgggtggccccactgagcccccagcaccagagagcttggctctgcaggtgcttcggggcgtggcagcagttcgtgcaaagagggtcccggtaccgagaccacctggctgaccgccggacggggaccctgaggaaatgcctggaacagtgggtgcggatgaagcagctccgggaatcagatggggcaaaggtgacccagctgtccctctgccggcagaaagcaggacgtgaggctgtctacaccgcaggccctggagcctgtggcctgggtgcagtgggccaggcccaggggcagcaggagcaaggccggggctccctgcaggatgcctgccggacactggccctctgctgggcgctgctgctgtggaagatgcggcttttccagtgccagtgggccaactccttcttccagggcctgcagcagcggatgctgcagcgcagcctgagatggtggcacttgagggcactgggcccagatgccacatcaagctgcaccaagaccccctcggctctggagccactgagcagcatcacactccaagactctctggagaaggttcccagggcccccaccctcccggacactctccaggggagccttctgtgggcagctgggcagcggcagcaggggcagtgccttctgctctggcaggcacgggcccagcagttccagggcacagccaggtggtaccagcatacccgccagaggcgcatcttcctcagctggagccgctgggcaacagcccaatgggcctggagagagctggcttcccaccgggcctgggatcggacctgcagggctgtgctgggcctgtggcatcagcggctgctgcagtcacggctggtggagcggtgggcccaggagcggggctggcggctggcacgagatgccctatgccactggcactcctgttggcaggggcagcagttcctgcatgaaaagtgccagacatgggtgcaggtccacctccagggcctgcagaaggtggtgttccggagctggcagcaggcagcagctcatcagagatgcacagtgacccggccagagcagctgctactgcagagctacttccaggcctggtgtgaggttgtaagagacacgggggtgctccgggcccagcatcaagcctttcaggatggcctgaggagaagagcactgggggctgtgtttgccacatggcgggaagcccaggaagtggcagccggggcacaggagcagcgtgtggcccaggcctcccttgcccgctggagaagctgcgggcagcaaggccaggaagatgggcagcagaagaaggcccgggccccacaggccttcccagcatggccagtggccccgggcatgcaccatgaggcccagcagcaggcaggagagagcgctggggcccaggcagcccagtgctggacttggtgctgggctctgtgggtgcatgagtcctgtcggggccaggtcagccgagcccatgcttcctggaagccgcgagcctgggtcctagaggcctcggtgcagtcggcggtgcgcggcggtgtccagcgagccatcctcacccagctccggccggctgagctcaggcgcttcctgcggacagtgcagctcagggtgcggctgggactgccaggggccggcaagacccgcagctgctggacacaggccacagagctggtgcctcccgcgccatcactgcagtgcagcctgggtggacggaggaagccaaggggaacggcctgggctcagaggtgcagggaacattccctctgccctgccttccagctctggccacagtggcctggacagagtagctgggtcccaggcctgcccctgtggacgagggaccagggaccaagagcgcactccagccctgagcccagagcctgcaaagcccaaagcaaggcccataaacggaggctacggatcctggaaaagcaggcccaggcccatggctctgccctccttctggccctgaagggtcacgatgctcttggccatcaggaggaagtacctgcagcgccggtgcctcgaggcactgcttcacgggctgcggggttcccagcaggccaggtgcctggcagtggcatggcagcactgggtggatgcccaaggggcagagcagctggtgcggaccctgctcagggagtggcacctgagatgggcctggcagacgtggtggcagcggatcctgcgactgcgagtggctcagcagttacagcagcaggaagatgggcctttaagaagtggcaccaacgcctggcagccaggagcccaaggagaggagctgccagtagcccaagaccctggagcaagccaggccccaagggccccgagagtggacaggaagccgccggagcaccgcggggttgggggcttggggcagagcatggggcccagctgcagctgtgacttgttctcatagaataaaaaacagaactgaacttagccttcccagggaaggaaccatgccccacacatccagggagtgatgacagaggggacagcttgaagagctctgaaggacaataaaacccactcctcagtcctagctgctgctttcagtctctcctagcggctgcccctctgccccagccagtgaggccaggaagggagtaaagaggacatcccacaattgcgtccacccccttggccatcaggctgctcttccactacacgaaacagcccatctgcacctgccagtcactgcccccaggccctggggcttgcaggtgactcgtggggagccaggccaggcagataacctctgggacaggacgaggggatgaggaaggcagctggcaggacaagggcctacctgaaaaatacaccaggaagctgggctgctgcacaggcccaggcagatctggggcccctgtgctggcaaatctcatcttagcctctgacagggaacggggcagcatcaggcctccacagccaggcaaaaggggaaggccacgagccccaccaagcacaagggttcagactgccttcaacccttaaggggcactttttctctcaaggctcagaatagacaactgtgccaaaaagcagcatggtaggtgtcagcccaatgcccatccagggggctggtgccatggacggctaagtgggcaggcagggcagtggtgtgccccttcagtcacaagtaggtggggcccagctgcccacctctaggaggtggaagggtacagcactttgccacatctcttctacgatgccaccagtgcctgatgcccttgcgtgttttgcctgtactgcacgggctccaagggtaagttcactgggagtcccaggctggctctggaggctgccttggttcgagggcttagttggcaacaaccactctcctcgccttctcaggaggtgccacccactgtggtcctctgcaggacgcaagtgctccccaccaaaagagcacagactcctggctagagcagagagtactaggttcccatgtggggccgactcaggtccaggaagagcctggaagcctcactccagtctagctgcc

SEQ ID NO: 65630 - DNA, 2335 bp, Homo sapiens
gaagaggagctcttgggccaatcacctagtttctgcctgtgttacagtgaagagaagctgcttaagagaagatgaagcccttgtctctgttaatagagatattgataattcttggggtcacaattaaaactatcaaagcagaggaacataataaaagacaaaaggaaagaaatgtcaccacacaggtatcagtgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagagattctaatgcctacctggatgtttctctgtctgaggtccttcttgcctggactactctgctccagcttctgcccaagagcagcttattttagcctcagcatggatgggctgtacataaagagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggaataggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtggcccgacgcacagttccagttaggcttcatgtactactctggctctggaatatggaaggattataaacttgccttcaaatatttttacctggcatctcagagtgggcagccccttgccatttattatctggccaagatgtatgcaacaggaacaggagtagtaagatcatgcagaactgctgtggagctttataaaggtgtctgtgaactaggccactgggctgagaaattcctgacagcttactttgcctataaggatggtgatatagattcttctcttgttcagtatgcactgcttgcagaaatggggtatgaagtagctcaaagcaattcagcattcattttggaatctaaaaaggctaacattcttgaaaaagagaagatgtatccaatggcgcttctcctatggaatcgagctgccattcaaggcaatgcatttgctagagtaaaaattggagattaccattactatggctatgggactaagaaagactatcaaacagcagccacacactacagcattgcagccaacaaataccacaacgcgcaagccatgttcaatctggcttatatgtatgaacacggcttaggcatcacaaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgggaatcagttcactccaaggtatccccactaaataaacagtttccca

SEQ ID NO: 65631 - DNA, 2108 bp, Homo sapiens
ccgcgcttaccgctggcctcttggaagacttgagggcgtggcctgtagagccaggtgcgccaagtgacaggcgagctagcggaaagccgcctcagggacttggaggatgtagaagtgggaggagaccgagggtcaacacgaattgtccgtgctcactccaactgccctgttgaggaggattttcaccagctatcaaagcagaggaacataataaaagacaaaaggaaagaaatgtcaccacacaggtatcagtgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagaagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggaataggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtggcccgacgcacagttccagttaggcttcatgtactactctggctctggaatatggaaggattataaacttgccttcaaatatttttacctggcatctcagagtgggcagccccttgccatttattatctggccaagatgtatgcaacaggaacaggagtagtaagatcatgcagaactgctgtggagaaaaggctaacattcttgaaaaagagaagatgtatccaatggcgcttctcctatggaatcgagctgccattcaaggcaatgcatttgctagagtaaaaattggagattaccattactatggctatgggactaagaaagactatcaaacagcagccacacactacagcattgcagccaacaaataccacaacgcgcaagccatgttcaatctggcttatatgtatgaacacggcttaggcatcacaaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgggaatcagttcactccaaggtatccccactaaataaacagtttccca

SEQ ID NO: 65632 - DNA, 2335 bp, Homo sapiens
gaagaggagctcttgggccaatcacctagtttctgcctgtgttacagtgaagagaagctgcttaagagaagatgaagcccttgtctctgttaatagagatattgataattcttggggtcacaattaaaactatcaaagcagaggaacataataaaagacaaaaggaaagaaatgtcaccacacaggtatcagtgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagagattctaatgcctacctggatgtttctctgtctgaggtccttcttgcctggactactctgctccagcttctgcccaagagcagcttattttagcctcagcatggatgggctgtacataaagagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggaataggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtggcccgacgcacagttccagttaggcttcatgtactactctggctctggaatatggaaggattataaacttgccttcaaatatttttacctggcatctcagagtgggcagcccctcgccatttattatctggccaagatgtatgcaacaggaacaggagtagtaagatcatgcagaactgctgtggagctttataaaggtgtctgtgaactaggccactgggctgagaaattcctgacagcttactttgcctataaggatggtgatatagattcttctcttgttcagtatgcactgcttgcagaaatggggtatgaagtagctcaaagcaattcagcattcattttggaatctaaaaaggctaacattcttgaaaaagagaagatgtatccaatggcgcttctcctatggaatcgagctgccattcaaggcaatgcatttgctagagtaaaaattggagattaccattactatggctatgggactaagaaagactatcaaacagcagccacacactacagcattgcagccaacaaataccacaacgcgcaagccatgttcaatctggcttatatgtatgaacacggcttaggcatcacaaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgggaatcagttcactccaaggtatccccactaaataaacagtttccca

SEQ ID NO: 65633 - DNA, 2108 bp, Homo sapiens
ccgcgcttaccgctggcctcttggaagacttgagggcgtggcctgtagagccaggtgcgccaagtgacaggcgagctagcggaaagccgcctcagggacttggaggatgtagaagtgggaggagaccgagggtcaacacgaattgtccgtgctcactccaactgccctgttgaggaggattttcaccagctatcaaagcagaggaacataataaaagacaaaaggaaagaaatgtcaccacacaggtatcagtgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagaagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggaataggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtggcccgacgcacagttccagttaggcttcatgtactactctggctctggaatatggaaggattataaacttgccttcaaatatttttacctggcatctcagagtgggcagcccctcgccatttattatctggccaagatgtatgcaacaggaacaggagtagtaagatcatgcagaactgctgtggagaaaaggctaacattcttgaaaaagagaagatgtatccaatggcgcttctcctatggaatcgagctgccattcaaggcaatgcatttgctagagtaaaaattggagattaccattactatggctatgggactaagaaagactatcaaacagcagccacacactacagcattgcagccaacaaataccacaacgcgcaagccatgttcaatctggcttatatgtatgaacacggcttaggcatcacaaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgggaatcagttcactccaaggtatccccactaaataaacagtttccca

SEQ ID NO: 65634 - DNA, 794 bp, Homo sapiens
gctctctccggtccccagtgcatgggctggagtgtggcccctggcagagccctggaggccggctctgcttcctgcccccttccagcctggagcagcccgagggcgcagcattcctggggcaggcctgagccctgtggtgggctgagttgagtccccagaaaggatctatgaaagataaaatgtggtgtgaggacacggcccagccccaccgtcgtcttccagccccaccatcgtcttccagccccaccgtcgtcttccagccccaccgtcgtcttctagccccaccatcgtcgtcttggactctctgggtggcaccacgctgtgggtgctgctctcctctgtgtcccaaacgagtttgtgcctcactttgtcgggttttggctgtgacttggagcctcaccaagctcccttttcctctgtctcccattctcctctccaggccagggtggcttccccagccctcctccccgggtcctgcctgtgccgagccttcctcccaggagggaggtgatactgacttgagatcttatgggtgttttgtttgtggctgggcctggccgaccctctctccacggccttagatcacactctggatggataggacagtcgtcctcaatactgagcctctttggagcatacccactgatggtggttcacaagctacccacgcccacaggctgacccagatctccgtgaaattaaaaaatactgtgaaaggaaaaagagccaatgtcatgtggataatgaagtgtcagccactgaaaaatctcaaaataacaaaaaaaaaaaaaaaa

SEQ ID NO: 65635 - DNA, 699 bp, Homo sapiens
atagtgatgccgtatccactgagactccggatcctaacagctggaagctaaaaacaggcgccatggagtacacagggagcaaatatatcggggaatatgtagatgggaggatggagggcaaagccaagtacatcctccctaccgaaacaatatatgttggggaaatgaaggatggcatgtttcacggcgagggagccctgtacttccccagcggaagccaatacgacgccatttgggaaaacggattggccataaagggcacatatacgttctcagatgggctgcactatgatgagaaaaactggcattactgcgacggctatgatcggaggttttacacagagatcctcaatggcttgaagcctgcaggtatggctcaactcaccaatatggacccacctagaaaaatccccaagggctattacgattgtggagacggcttctataacccagtcacgagggtagtcaaggactataggaaccgctttctaagaaacgcagatgatgacgagcatgagtggatcacccgtacctgtcgaaagggctaggatgagatcgtgggtcacaggcccgagccgtgaactctgtggctgcctccaccagaggtttccatctgccctactagcattggctgccctgggggacgggctgtagttctagaacctgattttaactcaggaataaagactttctgcggtc

SEQ ID NO: 65636 - DNA, 2659 bp, Homo sapiens
ataaggctacggatgggcgggacggagcagcccaccgcaaagtggcggtttacttgaggcggttaccttagtactccgagtagactgagtctgtggcgagctgcgggccgattcctggccagtgccatctcagccggagcaggcctcggggcctcagaagcaggcttttatctggcccgaggctcccagccgttcagcgcgtcttcccataacctataccgattattgggactctcggctgcagacacaggagtcacagatgctgggaagtatggcccgaaagaaacctcgaaatacctcaaggttgcccctggctttaaaccccctgaagagcaaggacgtgttggcagtgctggctgagaggaacgaggctatagtaccagttggggcatgggtggaacctgcctcaccaggtagttcggaaatcccagcatatacatcagcatatttaattgaagaagaactaaaggaacagctaagaaaaaaacaagaagctttgaaacattttcagaaacaagttaaataccgagtaaatcaacaaattaggttgagaaaaaagcaacagcttcagaagtcttatgaaagagcacaaaaagaaggctccatagccatgcagtcttcagcaacacacttaacttccaaaaggacaagtgtttttccaaacaatttgaatgttgctattggaagttctaggttacctccttccctgatgcctggggatggaatagaggatgaagagaatcagaacgaattattccaacaacaagcccaggctcttagtgaaactatgaaacaggcacgtcaccggctagcatcctttaaaaccgtgattaaaaaaaagggatcagtgtttccagatgatggaaggaaaagctttcttaccagagaggaagtgctttccaggaaaccagcatccactgggataaatacaggaataagaggagagttgcccattaaggtccatcaaggtcttttagctgctgtaccttaccagaattatatggaaaatcaggaacttgactatgaggaacctgactatgaggaatcttcatctcttgtaactgatgagaaagggaaagaagatttgtttgggagaggccagcaggaccagcaggctatccattctgaagataagaacaaacctttcagcagagttcagaaagtaaaattcaaaaatccattatttgttctgatggaagaggaagaacaaaagcagttacattttgagggccttcaggatattctgccagaagcccaggattattttctagaagcccaaggtgatttgctggaaacccagggtgatttgacaggaatccagagtgttaagccagatacccaggctgttgaaatgaaggttcaggttactgagccagaaggccaggccattgagccagaaggccagcctattaggacagaaactcagggtattatgctgaaagcccagagtattgagctagaagaagggagtattgtgttgaaaacccaggattttctacccacaaatcaggctcttctaacgaaaaaccaggatgttttactcaaagaccactgtgttctccctaaagaccagagtattctactcaaatatcaggaccaggacttcccacccagagaccagcatgttctccacaaagaccaagatattctgccataatatcaggaccagaattttctacctaaggaccagaattttttatctagagaccagcatgttctccccaaagaccaagatattctgccaaaatatcaggaccagaattttctacctaaggaccagaattttttgtctagagaccagcatgttctccccaaagaccagaatattctacctaaatatcaagaccaggattttctacctaaagaccaggactttttatctagagaccagcatgttctccccaaagactggaatattctacccaaatgtcaggaccaggattttctacccagagaccaaggtgttcttcccaaagaccaaaatattctacccatatgtcaggaccaggattttctacccagagaccaaggttatcttcctaaagaccaaaatattctacccatatgtcaggaccgggattttctacccagagacctgcatgttctctccaacgaccagaatattctacccaaatgtcaggaccaagattttctaccaaaatatcagaaagtacactttaaggagccatactctgatatgacagatgagaaagggagagaagacttttctctggcagactatcagtgtttgcctcccaaatcccaggaccaggatgacatcaaaaatcagcaacctgcatcttttatgagagaagaaagagtgagagaggaattgcctctggactatcatcaatatgttgtacctaaaatccaggaccaagactcccctagagaacagaacaagcatatcaaactaccctcatcttttgagaaatgggagattgcaagaggaaatactcctggagtgccattggcttatgataggtatcaatcaggattgagcactgaattccaagctccactggcatttcagtctgacgtggataaagaagaagataagaaagagcgtcaaaagcagtacctgagacatagacgacttttcatggatattgagagagaacaagttaaagaacaacaaaggcaaaaagaacaaaagaag

SEQ ID NO: 65637 - DNA, 8751 bp, Homo sapiens
atgagactggatgagataacgaaatcagagaatgaagacggagaaaagaagatgtttactcagcagtttgaaagtactgatgcctgtgtatatgaggtgtatgtgaaaataaattccattgtgaaatctcagagtcagtgtggattgaaaagaggtagtcccgagactgagctctggggtgctatagtgttcagaagccaggaagagaacgcaaaaccagtgaaggaaactgaggtgacagcctctgatgcagattcaggactctatggctttattgaatattctctttatgatggattcctgagctatgaagcacctcaggcattccggatcgaccctcatgatgggcaaatctgtgtttctcaagatatcgacagggaaagggatccagctacctatgatctcctggtggaagctaaggatggggatgagcagagaatgacacatttagccctggtgaagggtgggctaagtgcccaagcctttgttcgtgtggacctggaggacgtgaatgataatcatcctgtgtttaacccatcaacctatgtgacgagcatcagtgatgagacccagccaggcaccgagatcatcaatgttcttgccactgaccaggactctgggatatatgggacagtggcttatgagcttattccaggaaacgtgtcgtccctttttaccattgactccaccacaggactctatagtccagaggtagaaattctgagtgctgtcaacttttcagcagacaaggaagtaatgaacagtttagagatgtttttacctctgctaaggcacttcaagaaggttgaaagagatgaggaagctgcagaaaaaaaatttgaagctagcagaggttggttcatgaggtttaagggaagacgccatctccattacctaaaagtgcaagatgaagcagcaagtgctgatggagaagctgcagcaaggtatgtagcaaatctagctaagattcttggtgaaggaattatttacttaacattacctcttagtcatttggaatctaccacactttcgttgatggtctctgctcaagacggtggtgggctcacagctgtcattaatgccgatgtcaccatacacattttccagacaactctggcacctgctgagtttgaaaggcctaagtacactttcttagtttatgaagatgtgcctgaagatagtcccattggaacagtgaaagcaagagagcccttgaactcctcagaaccaatcttttacaggatttcttctggtgatctcggcggaaagttctccattcacccgcggctgggcactattcgcacccggaagcccctggatcacgagacgcagcccgtggttgtgctcacggtgcaggcgcagctcggcagcgccccagcctgcagcagcaccgaggtcaacataacagtcatggatgtcaatgacaaccacccagcgttcctcaggacctcggatgagattagaatatcccagaccacgccccctggcacagccttgtacctcgcacgtgcggaagacagagacagtgggcggaacggactcatccggtactccatcgccagcccgcagccaggcgtctttgccatcgacagagccctgggggtgctgttcctcaacggcagcctgggcgcgggcgagcagcgggagctcacgctgactctcagggccgaggaccaaggcgtgcatcctcaggcagccctgctggtgctgacagtcgttatcgagaaacgcgaacacagcccatcctggactttcgaacatttggtctatcaagtggaagtcagtgagtctctctcaccgatgacacaaatgctgcaaacacaggcgcacccacttggcccccagcgtgcagcctcgcctcttaggtactcgctggaacccagcgtagactctgctatgtttggaatccgcccttacacgggctggatttatttgcggcgacagtttgactatgaatccacccaaacatataattttagagtgtttgcttggatccccgaggacggattcttgcaaaatgtgagcactacagtcattgttcgtgtctgggatgagaatgacaattcccccaccttcttgcatgatgtgttgtttttgaaagtcgaagagagccctgttccccaaggggtaataggcaaaattacagctattgacatggactctggaaagaatggacagctattatatttccttttgtctgatggaaaattcttcaagatgaatcctaatacaggtccagcaggcaccatctatgtcataacctgggcagatggtgctgctgcctttagtgggacagactttgcattcagttctgatgaacttcaagcctttgttctcaagtctctgttctgtgaattaggagaaggagagttaatcaattgggtggcactggatcgtgagcaccgggggcaccatgagatgactgtgctagtgacagaccgcggctccccaccacgaaacgccaccatggcggtttacgtctcagttactgacatcaatgataacaggcccttcttcccccagtgtctccctggaaaggagttacacgtgaaggttctggaaggtcaaccagtaaatatgttggttacaactgtgtttgcaaaggatcctgatgaaggaaataatgcagaagttacatactcagtatcttcagaagatagttctgatcactttaagattgacgccaacaatggtgaaataagaacaaccacaatactttcgtatgattatagaccttcctacagaatgagtgtcattgccactgaccagggagtgcctcctcttcaaggacaggcagttgttaatattcaggtgatcccactatccaaagggagagcaatcatgtctcagaatattagacatttaattataccagaaaatttgaagcccacaaaaataatgagcttgataaagtcatctgatcaccttcaacaacattataatggaaagttacattttagtattgttgcagatgataaggatggacactttgaaatagacagctcaaccggagacttgtttctttctaaggaacttgattatgagacgacatctcattatcttttcagagtgattactacagaccatagcaaaaacctttccctgagtagcacagtcttccttagtatcgatgtggaagatcagaatgaccattccccatctttccaggatgagctcattgtgatcagtgtagaggagaatgttcccataggaaccctggtgtatgtcttcaatgccaaagatgatgacggcagttttttgaacagtagaatacaatactacattgaatcccacaaccctggcacgaatccatttctcatccacccctcatttggcacactagtcactgtgtcccgtcttgacagagaaagcattccaactgtcatcctgacagtaacagcatctgatcaggctgtgaatgtgacagaccggcgactgagatcactgacagcacaaatagtgattttggatgtaaatgaccacaaccccacttttatttctttccccaatgcccatgtcaaagaggatgtcacagtgggctccttggtccaccacataactgctcacgatccagacgaaggaaggaatggaaaagtaacatacagcatcctctcaggaaatgaaaacatgacgtttatgctagatgagtcatcaggcttactaaccacaacctgtcctttggattatgaaatgaaaactcagcatattctgactgttctggcactggatgatggcacaccagcactttcttcatcccagactttgacagttactgttcttgatgtaaatgatgaagctccagtatttaagcagcacctgtatgaagcctcagtgaaagaaaaccaaaatccaggggagtttgttaccagggttgaagctctggacagagattcaggagtcaattccaagcttcagtttgaaatcatgccaggtgcttcatttgaattattcgagataaattctgacactggagaggtagtgacaaccaccatacttgacagagaaattcaagaagtcttcacccttcgagtactagtacgagatgggggattcccttcattgtccagcaccacaacaatcctctgcactgttgaagatgaaaacgatcacgcaccagagtttattgtttccagttatgacattgaggttctggaaaaccaggaaccagaggttgtctatacggttttagcctctgatatggatgctggcaataacagagctgttgaatatcacataattgatggaaatactgatgagtgctttactataaatgagatgtcaggagaactctcaaccactcgtgctttggaccgggagcaaatcagcaattttacccttgtcattctgtgctctgacctgggagatccacctaggagctctgtaatacacctgcaagttagagttttggatgccaatgaccacagtccttcttttcccacactttattaccagtcctctgtgagagaagatgctgaagtgggaacagtggttcttgtgctttcagctgtggacaaggatgaaggcctgaatgggcaaactgagtattttctgactgatgaggcttctggtgcattcaccattgatcctatgtcaggcacattgaaaaccagcaacaccctcgaccgtgaagccagatctcagcatacatttagtgctgtggccagagactgtagcatccagggttcacgaagcaccactgtaattataaaagtatatgtcactgatgttaatgacaatgatccagttttggaacagaacccttttgatgtgtttctttcccccgagtcgcctacaaaccagacaactgtcattgtgagagctgatgacctggacttggggcccaatggaactgtggtttttagttttgcagagacccagtcaatgttttctattgataaatacacaggagaaattcaatttcagcaaaatccatcttcagaatacttccctatctggctgcagttaaaagttacagaccagggcattccagccaggacaaccacgggtctcttggtcattcacatggaaggagaagatgtaaagatttccttcagccaccacctgtataaagggctcgtgactgaaaattgtgaggcaggtacttctattgtgactgttaaagcttttgctcctgactcaattcaggacagcatgaaatattcaatttttagtggaaatgaagatggagttctttccctgtgctctaagtcaggacaactcactgtgaaagaacccaagtttcttgattttgaagtcagaaatgaggttcaactcatcgttttagctgaaagtagtgggcatagagcctattgcaaagtagcagtcttgatacaggatgagaatgataattcaccatgctttgaacaaagcatttaccaggcatcagtgtctgaaagccaactctacaatgctcatgtcatacaggtttttgctaccgacttggacagtggtttgaacggcctgattgagtattctattctgtctggcaaccaagaagaagcattccagattgatgcactgagtggtgtgataacaacaaaagcgattctagattacgagctcaccagctcctacagcttgattgtccaagccacagataaagggatgcccaggctttctaatacgactgtaatcaaggtacaggtgactgatataaatgacaatgccccagcttttctcccctctgaagcagtggaaattacagaagattctttgcctggtgtaattgtgactcatgtgtcagttcatgatgtggatttgaattcagctttcatattcagttttgccaaagagagtaatcctggaaccaagtttgctattgatcagaacactggagtggtggtgttggtgaaaacattggattttgaagaaatgactgaatatgagctgctcatccaaatttctgattcagtgcactacacagagggagcacttgtagtccgtgtgctggatgtcaatgataatccaccagtgttttctcaagatttctatcaggtcacagttcctgaatcaatacctgtggggtattcagtgctgactctgtcagccacagacttagaaagcaatgagaacatttcttacagaattctatcctcttctaaggaattctccattgatcctaagaatggcacaatatttactatcagtcccgtattacttctggatacaatatcaacaactcaatttcttgtggaagccagtgatggtggaaatcctgacctgagagctcttactttagtggagataggaatagaagatatgaacaattatgcccctgaattcacagtcaaatcctataatcttagcctaagtgaggatgctctggttggaagcacgcttgttacattttcaaacatcgaccatgactggacccgtgaaaacacatatgttgaatattccatcatcagtggtaattcacagaacaattttcatgtggaaactaagttctttcattcagaatatccttataagcaagtcggttatcttgtgttgcttcacagtctggacagagaagcaagtgctagccatgagcttgtcattctggcatctgacagtggctgccctccattgagttccacagctgtcatatcaatacaagtacttgatgtcaatgacaatcccccaaacttcagcagcctgagctatcacacccatgtcaaggaaagcacccctctagggagtcacatcactgtggtctcagcaaatgaccgtgacacagggtcacatgcagaaatcatctacaacatcatctctggaaatgagaagggacatttttacttagaagaaaacactggagttctttatttgattaaacctctggattatgaaaaaatgacaaaattcaccttaactgtccaagcttcagatgcagaaaagaaacatttttcttttgcagttgtgtttgtcagtgtcctggatgataacgaccatgcacctcagtttatgttctcaagcttcagctgtattgttccagaaaatctgcctatttcctctaccatatgctctataaatgctctggattttgatgctggtccgtatggagaattgacctattctattgtatcaccctgttttctcactcatggaatgtcttatgatcatgatctcttcctcattgaccctttgacaggggatattcatgctaagcaaatccttgactatgaaaatggcaataaatactgcctcacagtccaagccaaagacaaaggtgatgcaactgcctccttagtggtctgggtggatattgaagggatagatgaatttgagcccattttcactcaagatcagtattttttcaccctcccagaaaagaataaagacagacagttgattggcagagtggaagcctcagatgcagatgctggtattgatggagtcattctttactcccttggaacctcatctcctttcttttcagtaaataaaaccaatggaaatatttatttgattagagcccttcccctaataaaaagtcaactcaacaaagaagacaccttggaaatgaaaataatcgctcatagtcccaaatcagattccaagtttgcatcttgcactgtttttgtgaatgtgtctttctcctctgaaggaacacccttggcagtgttcgccagcagcttttcaatcagcctggtggtctcctttttagtgtttctgatactcatctgcattctaattgtaatgattttaagacataaacaaaaagacacaataaacaattatgaggagaagaaaacctcatctttagatgcggacttgagagtgacccgggatgccagtgtgctcaaagccttccagaaaactgacgactgcagtaacgaggtggtccctgtggatgccactccggaatggttgagtttaataagtatcatggagaaggatattgtcaatctgtacagacactcaaactccagtggccactgttctgtggaaggagaaactgcagaagataaggaaatccagaggataaatgagcatccctacagaaagtgctcagactcagctctgagtgaccacgagtccagggtgccagactcgggtatcccgagggactcagaccagctctcctgcctatctggggaaactgatgtgatggtgactgccgaaacagcagaagccagccaaacatttggggaaggagatcaaggggaaggctgcagcaccacctgtgctcaaaataatgtgttaccccagacagttcagaagagagaggcaaaagagagcatcctggctgacgttagaaaagagtctgtctttatttcaggtgatcaggaagtaaggtgtgcagctctttcaactcagacgacctctgatcatgatggaaaagacaactatcactggaattatcttcttagttgggagcccaaattccaacctcttgcctcagtatttaatgatattgcaaaactaaaggatgaacatttgcatatgcctggcattccaaaagagaagaaatcttttgtttttccaccccctttgataacagcagtagcccagcctgggattaaagcagtcccaccaagaatgccggcagtaaacctggggcaggtgcctccgaaacacccacgctctcccatcccctaccatcttggttctctgccagaaggcatgactcccaatttttctccatctctttccctattgacgatgcagcctcctgccttgtctccactgttgagagaaggagaattattaggaacacacatcagtggtacatgccatgaacttaaagcagaagatgaagttcaaatatga

SEQ ID NO: 65638 - DNA, 4193 bp, Homo sapiens
agaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcctttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacgacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcattatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaaattttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgccgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcgtagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaacctgttagaatatgc

SEQ ID NO: 65639 - DNA, 2252 bp, Homo sapiens
agctgtgcgacgcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaagttacctgggatgtttctttgaatttgttttatagtttctgtagcatttggcaattgctgttagaaaacactagctagaaatcccctccccaccaccctttttaaggccagttaactatactacagtcaataccgtggtgagcaaaaatgtaaaaggtggaaggagaaaacttactaaaatagtatgttttcctattataagggacagacttggtattcagtatttgtcaaatattacatgtgttattcaggagatagattaatgcattaaagggatgtaagcacttttattttaataaagtgccttataacaa

SEQ ID NO: 65640 - DNA, 2352 bp, Homo sapiens
agctgtgcgacgcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaagttacctgggatgtttctttgaatttgttttatagtttctgtagcatttggcaattgctgttagaaaacactagctagaaatcccctccccaccaccctttttaaggccagttaactatactacagtcaataccgtggtgagcaaaaatgtaaaaggtggaaggagaaaacttactaaaatagtatgttttcctattataagggacagacttggtattcagtatttgtcaaatattacatgtgttattcaggagatagattaatgcattaaagggatgtaagcacttttattttaataaagtgccttataacaa

SEQ ID NO: 65641 - DNA, 2331 bp, Homo sapiens
aagctgtgcgacgcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaagttacctgggatgtttctttgaatttgttttatagtttctgtagcatttggcaattgctgttagaaaacactagctagaaatcccctccccaccaccctttttaaggccagttaactatactacagtcaataccgtggtgagcaaaaatgtaaaaggtggaaggagaaaacttactaaaatagtatgttttcctattataagggacagacttggtattcagtatttgtcaaatattacatgtgttattcaggagatagattaatgcattaaagggatgtaagcacttttattttaataaagtgccttataacaa

SEQ ID NO: 65642 - DNA, 1424 bp, Homo sapiens
gaaggactggggaagactggatgagaagggtagaagagggtgggtgtgggatggggaggggagagtggaaaggccctgggcagaccctggcagaaggggcacggggcagggtgtgagttccccactagcagggccaggtgagctatggtgctgcacctactgctcttcttgctgctgaccccacagggtgggcacagctgccaggggctggagctggcccgggaacttgttctggccaaggtgagggccctgttcttggatgccttggggccccccgcggtgaccagggaaggtggggaccctggagtcaggcggctgccccgaagacatgccctggggggcttcacacacaggggctctgagcccgaggaagaggaggatgtctcccaagccatccttttcccagccacagatgccagctgtgaggacaagtcagctgccagagggctggcccaggaggctgaggagggcctcttcagatacatgttccggccatcccagcatacacgcagccgccaggtgacttcagcccagctgtggttccacaccgggctggacaggcagggcacagcagcctccaatagctctgagcccctgctaggcctgctggcactgtcaccgggaggacccgtggctgtgcccatgtctttgggccatgctccccctcactgggccgtgctgcacctggccacctctgctctctctctgctgacccaccccgtcctggtgctgctgctgcgctgtcccctctgtacctgctcagcccggcctgaggccacgcccttcctggtggcccacactcggaccagaccacccagtggaggggagagagcccgacgctcaactcccctgatgtcctggccttggtctccctctgctctgcgcctgctgcagaggcctccggaggaaccggctgcccatgccaactgccacagagtagcactgaacatctccttccaggagctgggctgggaacggtggatcgtgtaccctcccagtttcatcttccactactgtcatggtggttgtgggctgcacatcccaccaaacctgtcccttccagtccctggggctccccctaccccagcccagccctactccttgctgccaggggcccagccctgctgtgctgctctcccagggaccatgaggcccctacatgtccgcaccacctcggatggaggttactctttcaagtatgagacagtgcccaaccttctcacgcagcactgtgcttgtatctaagggtggggggtcttccttcttaatcccatggctggtggccacgcccccaccatcatcagctgggaggaaaggcagagttgggaaatagatggctcccactcctccctcctttcacttctctgcctatgggctaccctccccaccccacttctatctcaataaagaacacagtgcatatg

SEQ ID NO: 65643 - DNA, 1169 bp, Homo sapiens
taagagccagggggggaagaggggctggctccggtagattgcaaacgacctgctttctttctgatcccgggctgcgttcggacccctgtcgtatagaaaatcccaagtaaggtacctgccgtcggcagatctgagctttcttcttggacacctaatacccacagtcctccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagaagaatatgccctagctttttacaacatcgacagtagttcagtttccgagtgagacaaagcaattactagaagaggtaaagaaattttattacgtcataaaccattgaaaacacatctagtaagaaaatgaaaacctgaataagataggacaatagttgaagaaagaaaagtgtctggtacttcattagacttgtgtagctgtgtactgcatgagtaatctgataatcattaagattatattaatttctttaaaaatagctttaaagaattcacagctatatatgtaccttttataaatctctcatttttgttttgtaagttgacaggtcagtaaaaatttaggcatatatatttgtacatatgtgtgtgtatgtacatgtctatgtgcctatatatgcatgtttttatatctaaatatctatttatatatacatacaaacgtgtttattgtttaaatgatgttttaaatcccagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtca

SEQ ID NO: 65644 - DNA, 641 bp, Homo sapiens
tctgatcccgggctgcgttcggacccctgtcgtatagaaaatcccaagtaaggtacctgccgtcggcagatctgagctttcttcttggacacctaatacccacagtcctccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgc

SEQ ID NO: 65645 - DNA, 3631 bp, Homo sapiens
tagactgctcaccaaaatgggaggcagcctctgctgctgtggtgaaggtgaaggcttcttctaccgccagaattggcggtttctctcgctggattcttgggacctgatccaggcagcacactcgacacactcagcgattcagctctacagtatgcactctgggatctcccatttgctaaggaaggatcttagctttgagaaagtggcaagagatcccctcttgaggagactccgcaggaacaccagagatgatagtgacacacaacaactgaaggcagaggtacaggctgaggagaaaggtgtcaagcctgtggcagcagagcttcctggggagtcctcagagcaagtcattgccattgtcgaagtgtcttctaggctttattttggggccattacctcgagcactgtttcttgtctggtttcctaatgtcagcaactgaagaaaagacctgtatacacaggacacagcatggtctgacgctcacagtgttttcctttctctctgcagagggattcagcactttgggcaagtggttgcacagaggatcccgtggaagaattcatatatgaatcagatgagaatgccccaggaccatcgtagataccaacaagccctctcccggcacctgcagaaaaagtggggaaaatccccgaagaggcagaaacaaaacctagtgagctgaaggatgaggctgctgaagagcctgagctcacttgttgtggcctttgtacttatgctggaaatccctaaagattcatccggaagggccgccagccagtggatttcccgggcccctcagccctctggagtaaatgttaatggctgggcgcagtggctcacgcttgtaatcccagcactttgggaggctgaggcgggagaatcacttgagcccaggagttggagaccagcctgggaaacatgggctcacactcctctgaaacaactcacgaagagcctgaggaagcagttctcactggaaaatgcaagaaagtatgttccggtgaagaccctcagctctgttcattttcatgatgcaaatgcccacaaaggtggttttgacctgactgaccctgtgcaaggaggcacagtctcctcaccagcataagcacgtggcatcagatgcggagacagttttggacgtggatggatgtttacacactgagactccttcagtgtcccttcaagaaaatgtggacacaatgtctctgaagcctgttagtgaccatagaattaatttcactaatacctttcggtcaccgactcctgaaaagagaacacgtgaatatcatgagtccgttgaaaaaagacaaaatgaatctcacacagaatgtggtctatggaaatgaagagggcagaggggtcatggaccttgcctgtcacacatcttttacgagcaaacaaaatgtgatgagatgactgaagacttgagatctggttagtgataccaccaatgagatgagcaccacagttattcaagccagcccagccctgtccgaggaataggctgtggaaaaattgagagaatttccatttcagaatataggaaaaggaacataaaggaacattaccatctatgatcccaaacgactgatatgaaaaaatgactgcaactacttctctgagtagcaagcctaaagatgtaaaacctaaccttagatcaagtgaagatccttcctccaaaagtggagatctgttggaacccagtgaggtggattggacgtcagacctcaagaaagtggaccggatcgggctggctctcctgagcaagtcaggtctgagtcgtcagacggggtcagctgctcacacctccctgtgtcctgccaggagactgtagatgatgatcaaagaatcatcactaaagctacgtcaactgcaagttgtgagctcagaggccgggacctgttcccagcggaaccattcatggctctgcagctgagacgcagaacatggggctgcggtgcctgcactcttgatgtcacccctcccagcacagcttccttcagccagaggtattgaagaacactcccttcagctggaagtgtcgccctgcctcagtgccaggctggcagggccatagcctgtggcttctcaggaggccatccctatccagctgtcacgggagagcatgtgcagaactctgtggctgtggaatttgggaccaaataccggctctggatggatgggcacctcttccatctgcgacccatattctgatgcctcacatcggaacctgctaagcacagcgaagccttttcctgtgcattctattggtacaaactggaaagaaaccacgagattcaggaatgacatcagtactgggtagaaacagaacagaaagccattcttgattttggtgactggagttgtggaggctggaagtctctgccaataaaagcactgaactggacacacaccacttaccaatcaagttgattctcaatgttagcaccgtggcctggcaagatcggacgttttccgaggaacccggctgagctcctgtgagagctgctccctgcactgatgtggtcccttggctggcaggctgctctgtgatcaaccaggtgacacctgcctgttatgagggacaggtaggagaggatgggctttccatcaaaacaaacaaaaaaaaagtcccaagaaggaactcggctcttcagagattcaggactcaggagaagacttcgtagtgagagttgacgtagaagttgacagcccaaaccccacaccagttcttagaagtattgatctccaagaaagagcagaaagagctacaactcctgctcccagggacttacaggtcccagaatgagaaagtccctctttagtggatctagagaatctattcgttaaacctggagaagaacatgaggttatagtttctttttctccaagggatcccaaagtttgggaggaaaggatctaaaaaatgtttgtgcagccatttggacctcagtatgaagtggtgttaaaaggtgaagtccattcttcaggaagtaaacctctgccacgtggatcatgctcagacatcctattgaagtttgtccaacaatttcttgctttggaaggtgtctctcttggtggaacacagtttcaccttttgctggaactcagagctacaaatgatgcttaatgtaccaatgccttctgactgaactcctctctgccctgaatacaagagaccctaatagttatgtggaaatatcatcgccccgttcagcatgaagaagttacaaaagatggaccttcatccttctgcaacccttaggattaagggtcctcttgtaaaagggaggggaaatatgtaagaagcattcaaaccagagcgactccattttgaacaagggctaagaaaaatgaagctgggtcctgttgggctgcatgcccaggaggttaagcattcttagcctcaagatgtttacaattgagggaacagattaataatgtttcctaaacagactcaggacttaacagactcaggaacgtcttgatactttgagaacaaaagcacttctagttttaaatacgcattgtacctaggctggatgcttttcttacttttggaaatgccctaccctgtctatggagtcactattcattccctcctttattaaagttgcttctattttgcac

SEQ ID NO: 65646 - DNA, 2444 bp, Homo sapiens
aagaaaagaacaagttttcctcggcctagcaagctcacttcaaggacagttataagataatgctgtttgagaagccaaggccaaaggaatgggctgcagacatccctcccctccagaacaaggttgaaggaaaaaaaaaaagagaaagacaaattcctttactgttacttctttccctggcttcttaagcatgattatgttttacaaatgtctgtatttagccagttcttgattttcttttgacacagctccaaggccaccagctatgcaaggccacaagttatgcactatatgattaactgcttttgttttacttttgtaagtccacttataaaaaccctgctctgtctttgtttaatgctcaggtttttggatataaatccactcagccagtgcgtacctaaaaataaatatcttcctgtactctcatattggtctcgccattcctcagtttcctgcaacatttcttggcaagccagccaggagtggagatgacaggcttactgtctcctttgcctatagggggctggagccctgggccaagggagacctgtgaccccaggtgccgccgggagaacttcagcccagaggggaaatcagctctccgtgacccagcacccctacccagcagcgcaacagatcctgagaggagctacaggatgattctagaaacagcgcacttcaggaatcatgttgcaggtgttgtgcattggatccaccacagtcggctgaaactgacaactcaagacaagtggaccagccagcaggacccagatcatccaactcggctgatcctgagacgggaccaaactgctgccgaagacgaccgccctgttctggtcactccggaggctaaccagcctacgcatggctgaagtttgaggaaacaacaagccctgctctagtcacacactgaaagctgactagtctatgcacggccaaagcttgaggactcatcaagcaagtaaatgtagttagaaatcttagaactagtagttttccttgtaatattaactgttttactattgttctgtcactgtgctcaacctcctctcccaaataaggacctcttctgtccttactagatatgaatatactgtacattgttttactgttgttaccccacttaaccatgctagaagaaacacccatagaagggtgtccccatcgtacacatactacatggtcagaaaacagtataaccaggactctattataccatacttattatgagtatacagggactcacctaggaacttgtacttacaatcagatcacctattcaatttatgacccaggaaatggccagctacctaggtggaagataggtcatggagttaccgtactcctacttacgtgcttaagcgcatcataaggttacaggcagggcttgagatcatcactaataaacatcaaatgcattagatttactgacccagcaagctacaaaaaatgaggaatgctatctatcagaacagattagctttagactatctcctagcccaggaaggaggagtatgtggaaaattcaatctaactaattgttgcctggaaatcaatgacaatggaaagacatttatggaaataactgcaagaataagaaaattaacccacgttccagttcaaacgtagaaagggtggtctccagattctctctttggaggctgtttttcatttttcggagggttcaagactttaataagattgattctggccatactaggaagttgcctaatactaccttgtctcttacctctccttgttagaaacattcagtcaactatagaggcaatagtagctaggcaaactaccagtcagctaatggctctatgtaaatgtcaacctttgtctaaagaagaaaacttgtctcttcatgcaaaattaaataatagtgatgcctcctattaaatttcttttataaaaggcatcaaaggggggaaactgaggcagaaatttaaaaataaatatgcattcattcactccaagaaaagttaacaggcaaggcaagggttaaaaagaaaagaacaagttttcctcggcctagcaagctcacttcaaggacagttataagataatgttgtttgagaagccaagtccaaaggaatgggttccagacatccctcccctctagaacaaggttgaaggaaaaaaaaaaaaaaagaagaagacaaattcctttactgttactcctttccctggcttcttaagcatgattatgttttacaaatgtctgtatttagccagttcttgattttcttttgacacagctccaaggccaccagctatgcaaggccacaagttatgcactatatgattaactgcttttgttttacttttgtaagtccacttataaaaaccctgctctgtctttgtttaatgctcagctttttggatttgaatccactcagccggtgcacaccttaaaataaacatcctcctgtact

SEQ ID NO: 65647 - DNA, 3631 bp, Homo sapiens
tagactgctcaccaaaatgggaggcagcctctgctgctgtggtgaaggtgaaggcttcttctaccgccagaattggcggtttctctcgctggattcttgggacctgatccaggcagcacactcgacacactcagcgattcagctctacagtatgcactctgggatctcccatttgctaaggaaggatcttagctttgagaaagtggcaagagatcccctcttgaggagactccgcaggaacaccagagatgatagtgacacacaacaactgaaggcagaggtacaggctgaggagaaaggtgtcaagcctgtggcagcagagcttcctggggagtcctcagagcaagtcattgccattgtcgaagtgtcttctaggctttattttggggccattacctcgagcactgtttcttgtctggtttcctaatgtcagcaactgaagaaaagacctgtatacacaggacacagcatggtctgacgctcacagtgttttcctttctctctgcagagggattcagcactttgggcaagtggttgcacagaggatcccgtggaagaattcatatatgaatcagatgagaatgccccaggaccatcgtagataccaacaagccctctcccggcacctgcagaaaaagtggggaaaatccccgaagaggcagaaacaaaacctagtgagctgaaggatgaggctgctgaagagcctgagctcacttgttgtggcctttgtacttatgctggaaatccctaaagattcatccggaagggccgccagccagtggatttcccgggcccctcagccctctggagtaaatgttaatggctgggcgcagtggctcacgcttgtaatcccagcactttgggaggctgaggcgggagaatcacttgagcccaggagttggagaccagcctgggaaacatgggctcacactcctctgaaacaactcacgaagagcctgaggaagcagttctcactggaaaatgcaagaaagtatgttccggtgaagaccctcagctctgttcattttcatgatgcaaatgcccacaaaggtggttttgacctgactgaccctgtgcaaggaggcacagtctcctcaccagcataagcacgtggcatcagatgcggagacagttttggacgtggatggatgtttacacactgagactccttcagtgtcccttcaagaaaatgtggacacaatgtctctgaagcctgttagtgaccatagaattaatttcactaatacctttcggtcaccgactcctgaaaagagaacacgtgaatatcatgagtccgttgaaaaaagacaaaatgaatctcacacagaatgtggtctatgaaaatgaagagggcagaggggtcatggaccttgcctgtcacacatcttttacgagcaaacaaaatgtgatgagatgactgaagacttgagatctggttagtgataccaccaatgagatgagcaccacagttattcaagccagcccagccctgtccgaggaataggctgtggaaaaattgagagaatttccatttcagaatataggaaaaggaacataaaggaacattaccatctatgatcccaaacgactgatatgaaaaaatgactgcaactacttctctgagtagcaagcctaaagatgtaaaacctaaccttagatcaagtgaagatccttcctccaaaagtggagatctgttggaacccagtgaggtggattggacgtcagacctcaagaaagtggaccggatcgggctggctctcctgagcaagtcaggtctgagtcgtcagacggggtcagctgctcacacctccctgtgtcctgccaggagactgtagatgatgatcaaagaatcatcactaaagctacgtcaactgcaagttgtgagctcagaggccgggacctgttcccagcggaaccattcatggctctgcagctgagacgcagaacatggggctgcggtgcctgcactcttgatgtcacccctcccagcacagcttccttcagccagaggtattgaagaacactcccttcagctggaagtgtcgccctgcctcagtgccaggctggcagggccatagcctgtggcttctcaggaggccatccctatccagctgtcacgggagagcatgtgcagaactctgtggctgtggaatttgggaccaaataccggctctggatggatgggcacctcttccatctgcgacccatattctgatgcctcacatcggaacctgctaagcacagcgaagccttttcctgtgcattctattggtacaaactggaaagaaaccacgagattcaggaatgacatcagtactgggtagaaacagaacagaaagccattcttgattttggtgactggagttgtggaggctggaagtctctgccaataaaagcactgaactggacacacaccacttaccaatcaagttgattctcaatgttagcaccgtggcctggcaagatcggacgttttccgaggaacccggctgagctcctgtgagagctgctccctgcactgatgtggtcccttggctggcaggctgctctgtgatcaaccaggtgacacctgcctgttatgagggacaggtaggagaggatgggctttccatcaaaacaaacaaaaaaaaagtcccaagaaggaactcggctcttcagagattcaggactcaggagaagacttcgtagtgagagttgacgtagaagttgacagcccaaaccccacaccagttcttagaagtattgatctccaagaaagagcagaaagagctacaactcctgctcccagggacttacaggtcccagaatgagaaagtccctctttagtggatctagagaatctattcgttaaacctggagaagaacatgaggttatagtttctttttctccaagggatcccaaagtttgggaggaaaggatctaaaaaatgtttgtgcagccatttggacctcagtatgaagtggtgttaaaaggtgaagtccattcttcaggaagtaaacctctgccacgtggatcatgctcagacatcctattgaagtttgtccaacaatttcttgctttggaaggtgtctctcttggtggaacacagtttcaccttttgctggaactcagagctacaaatgatgcttaatgtaccaatgccttctgactgaactcctctctgccctgaatacaagagaccctaatagttatgtggaaatatcatcgccccgttcagcatgaagaagttacaaaagatggaccttcatccttctgcaacccttaggattaagggtcctcttgtaaaagggaggggaaatatgtaagaagcattcaaaccagagcgactccattttgaacaagggctaagaaaaatgaagctgggtcctgttgggctgcatgcccaggaggttaagcattcttagcctcaagatgtttacaattgagggaacagattaataatgtttcctaaacagactcaggacttaacagactcaggaacgtcttgatactttgagaacaaaagcacttctagttttaaatacgcattgtacctaggctggatgcttttcttacttttggaaatgccctaccctgtctatggagtcactattcattccctcctttattaaagttgcttctattttgcac

SEQ ID NO: 65648 - DNA, 2034 bp, Homo sapiens
atgccggaccgcgcatgcgccgtcggcagcgtcgcgcgcgccctgtcgcgcagccggcgctacgtgtgcgcccgggacgcggacgcaagccgccgacggaggaggccttttaactacggcctctccatcgaagaaaaaaatgaaaatgatgaaaactcattaagcagttcctccgacagtagtgaagacaaggatgaaaaaataagtgaagaatgtgatattgaagaaaagactgaagtgaaagaagaaccggagcttcaaacaaaaagggaaatggaagaaagaacagtaactctagaaatccctgaagttctgaagaggcagctggaggatgattgttactacattaatcggaggaaacggttagtgcaacttccatgccacaccaacatcataacgattttggaatcctatgtgaagcattttgctatcagtgcagccttttcagccaatgagaggcctcgtcaccatcacgctatgccacatgccagcatgaacgtgccttatatcccagcagaaaagaatattgacctttgtaaggagatggtggatggattaagaataacctttgattacactctcccgttggttttactctatccctatgaacaagctcagtataaaaaggtgactgcatctaaggtttttcttgcaattaaggaaagtgccacaaatactaataggagccaggagaagctctctcccagcttacgtttgttgaatccatccaggccgcagtctacagagagtcagtcgaccagcggtgaaccagccacccctaaaaggcgcaaagccgagccgcaagcagtgcagtctctgaggcggtcctcgccccacaccgccaactgtgacaggctttctaagagcagcacctcacctcagcccaagcgctggcagcaggacatgtccaccagtgtgcccaagctgttcctgcacctggaaaagaagacacctgtgcatagcagatcatcttcacctactctgactcctagccaggaagggagtcctgtgtttgctggctttgaagggagaagaactaatgaaataaatgaggtcctctcctggaagctcgtacctgacaattacccaccaggtgaccagccacctccaccctcttacatttacggggcgcaacatttgctgcgattgtttgtcaaacttccagaaattcttggaaaaatgtcctttactgagaagaatctgaaggctttattgaagcactttgatctctttgtgaggtttttagcagaataccacgatgacttcttcccagagtcagcttacgtcgctgcctctgaggtgcattacagcaccaggaacccccaggcagtcaataagtgttgatggttctgtaagaacaactgctccatctagcatggtgttctgagttccaggtaaaaaattaacaaggtggtgggtttttatccagagcacaaaacaaagtgcccaccagggggctttgacagaggtgtgccctgttgtttgagttccccatgtactgtagttactctgtttagaattatttcctaggtgcctgaaagtgttctgacatgacacttgctactttgtaggccatctgtgatggcaggtaaaaagcaactgttcacagtgaaatgttcatggaagtgtacataggttaggccatttcagcagacattgcagttagtcagcaagaaccacattgtttcgttatttgttagcattaaacaaaattttttttgcaaattggtttcattctcttgatgaagctgagcaactgtccaacaaggtttagtttgtacttgaaaactgcaaagtagtctcaaagtattttagagggaatccatattgatggcaaaagaaaatttgcagctataatttgcttctgacggttccttctctgtgaaacattatttttggtgatctaaagaaagcattgcctttcttgtttgcaattttacagctatacttttttgtgtaatgttatggttccctttctgtaaaatgttctttttggtgatctaaataaagcctctcttgtttgaaaaaaaaatt

SEQ ID NO: 65649 - DNA, 2444 bp, Homo sapiens; identical to SEQ ID NO: 65646

SEQ ID NO: 65650 - DNA, 3584 bp, Homo sapiens
cgcgcgcccgggaggctccgggaccgtggcggcgggcggcggcggcgcagccctccgcgggccatgtcctctccggcggtggcgaggacctccccaggagggagtcgggagatggccccagcgccgcagggccgaggccggttctgggaagtgggcggcggcagcggccatcggctggagcgcgcggccgcggagtcggagcgctgggagctgctgctccgccgcggggagctgctggcgctgggcggccacctgaagggcgcgctggaggcgttcgcggcggcgctgcgccgcggggccccggccaggcccgagtgcctgggcgccctggtggactgcctggtgttcaactaccggctccgccacgggctgggctggagcgcggccccggttgcaggcgctgacggcggcgccggcgggctcctcagatgcctgggctgccggggcttcctgagcgagccggtgaccgtgccctgtggccacagctactgccgccgctgcctgcggagggaactccgcgcccgctgccgcctctgccgggaccggctgccgcccgccaccgccagtgccactgatgctgaagggaccgccccgcggccgccgcctctggccgccgccatcgccgcttcagacttcagaaccagcgtcgtcctcaaccacctggccgagaagtggtttccgggccagcgcgagcgggcccgggcggccggcaggctcggggagctactgcaccaggggcgctaccgggaggccctggccgccgcctgcgaggcgctgcgagcagaacccagtgacttgattgtaaaaatttacagagcggaatcatatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagaaactcccaatgaagtctgtatgttttccttagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaacactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaatactttttctt

SEQ ID NO: 65651 - DNA, 1901 bp, Homo sapiens
ctgcctctgagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttactatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcagacacacccaggaccaatactttgcatccttcaatccaatcaagttggcactcggtattaaccatcacaattagaaaaagataagtattatttcatgtatttttttgtttcattaatatgtacacaaatgtgcacattggactataatgtaaaatgtgtcttttattgtgggtcatagtcactgaagtttgaaaaacattgactcagaacatctcatgacctagtcaggttgttggttatattctaaatccagcatgttttatttaattttgatttcaggacataaagatctggtccctgatgaagaaaaaaatctagctatgtcagatgcagcagagtttccaaatcagattcctcaaaccacctttgaaaagccacagagtcttgagttcctaaatgactttgaaggcaaagccgtggaatcctaacagatcaaattggatgaaatatataattacttgatagcacaataaacatagaaagaatttatatgaatgtctatatttaaggaagaataatttgaaagatttatgtcagtcttagataataccatgcaaggcaattaaatcactgtgacagcacagaggtcagagttccgtcattttgcattacttgtatccactcatgtttgtttcataataattgcattttcttagaactattttggtgtcaaatgctattttttatattacattaaaatagagttgtcagtcattgcatctgcccatacatcttttgagagaaactgcttccttccatcagccatacctaagacctgcacctaagtggccatgtttgctcaaatgtcctcatcaccttggcctcaactaattaggccaaacagatgtacttcactcaaggagaaccaatcatattttctctctgtctctcaaaaaaaaattgaactgagaccagtgagtaagttggtgtctgggtcaggttaatggtggtgaactatgtgcctgtgagctcttcagagctggttgggttcaccaccttcataagacctgcctctgtaccatttttccttgagtgtgctttgtataaaggtctgtacaataaatcacacttttttaaagcttaaaaaaaaaaaaaaaaaaaaaaaaaaaa

SEQ ID NO: 65652 - DNA, 1532 bp, Homo sapiens
agtttcccaatcaggtagtgagagtggcacgaaccagccgttctcctgagccaccccccgcgcccccggactcctcaatatcccaggtgggaacgctcaccagggacatccagcgcccgtcgccctgtacgtcctgcaccggcgtgggcttgctggctgggttctcctctccactcatcttggcgccgcagctcctgcaggatgagcgagtcgggtcggcccgggagtgttccgaacggagctggctccgccacgcccactcctacccctcgcggcaacaaaggaccgtcccaacgctagcacacccgcggaggacgaaggccgatacagggcgccgcctcctctccagggacggaagccttcacttaggaggacaccatggatacccagggaccagtctcccagccttttcagcagcctgagaaacctggtcgtgtccgtcgtcggaagactaggcgggaacgtaacaaggccctggtgggcagccgccggccattagcccaccacgatcctcctgtggccattcgggatccacctgtggtccctactgcctccaagctcgtggtcataacccagggccggctgagccgggagcaccggggtctcttcaaccacgaggtgaaatccctagatgttgcaaggctgcttagcagtgggaccctggtgccaggcagccccacactccccgccaagccctccccaagcccaggcagggcccaggaaccagccccacggtccagggacaaagagaaccaggtgcctggaggttcgggcccaggcccacccagttccccagagttgtctggcgtggggcagctgctggcagagctgcagtgtcagctgagtttgccacaggccttcccccggaggaacctgattcaggatgccagggatgccatcgtgcacaccttgcaggcctgtcatggttgtgtgcctgaccttgccctggtgcttcggggctgccagccacccttgccaggggccaagcctggggtctctgagagaaagatgacacccttctggattaatagccctgatcaagtcccagagcaggagaggcaaaggaagcaacaagggacaaaggagttcaccttccccatgccctacacctccagcatgcccactgcgcacagggggagtctggcaccgccaagaggtccctggccaccatactttccctcactgtcttcgccatctggaacagcctggggtcccccaacagcgtttgacttgttaaaaagcatctggctggtagccacgccaccccctcctcggccctggggggttggcctccctcagcccctgcctcagccttcatcacccctgttgccccgaacctctgtcctggactggagccccagccccccttccccactgcccagcctctcctgggtagtagcccagagcagtccggaagcctggtcttttccacccatgagactgtactgaggagaggctgaggctagggctggggacagatatcttgtactcccagtgacctcaataaagtacttttcatggtcctcttgaaa

SEQ ID NO: 65653 - DNA, 5834 bp, Homo sapiens
ggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaatattcaggcatctcaacaggttctgagtggtgttgctcagccagtagcttttggtcaaggacaacagtttttaccagttcatccacaaaatcctggatttgttcagaatccttcaggagccctccctaaggcatatcctgataatcatctcagtcaggtggatgtaaatgaattgttttcaaaattgctaaaaacaggaattctcaaattgtcccaaactgattcagctacaacacaagtaagtgaagtaactgctcagcctccccctgaagaggaggaagatcaaaatgaagatcaagatgttccagatcttactaattttacagttgaagaattgaaacaacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagactggatagaatttgaggagatagctgatctggaagaacgggcaaagagccagttttttgaaaaggtgcatgaagaagttgtgctcaaaactcaagaggctgctaaagaaaaagagttccaaagtgtacctgctggaccagctggagcagttgagagttgtgaaatctgtcaagaacaatttgaacaatactgggatgaagaagaggaggaatggcatttgaaaaatgctattagagtagatggaaagatttatcatccatcatgttatgaagattatcaaaatacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaag

SEQ ID NO: 65654 - DNA, 5587 bp, Homo sapiens
ggccttcgtccctactgcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgcactgagccgagatcgcgccactgcactctagcctgggccatagagcgagagtccatctcaaaaaaaaacaactatttttcacataatcaaactcaccttgtctcatgacttttggttaagggggttttcccatagtttatttttctctcagtgcatcttgctatgaggtttgcttgttacccttttggtttttgaattgttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgttacctgcaagttatgttcttcttcattgaatttcatatttgagagacatttgtcttcatgaagcagatttgcactggaaccattgctttactctggttggaaatgccattgttttggggacagacttttaaaatgcccttgtgtctcccagtgaggagccctaagcattgacttctctaccctaaaactgtttgagagagggagagtgggccctggctttctcaagcatgggtcgggggttcagcggggcctctgtcttttgtggtgacccctcaggggtttcattgtttccttctgacttaagcaatagagagagaatttgttttggtactcttcagaggaattgtgctttggctcataacttggccatgttctccatgaattagttctcctatttttttttttaactaccttaaacttaagggaaaagttctcctatcttgatttcactggaatataggctttaggagctctgtaaggctggtatttttgtctgttttatcttctactgtatcgccagtgcctggaacagtgtctggtgcacataataggtgctcaataaaaatgtgttcaatggatgaatttctaaaatatcctccaatgtgtgcatggaacaaataatcaaaagaaccagactgtgtcttattctcccactgacagaaagattttcctgctttcaggaaacaagctttatgtggcccttttctggtcccctggcttagactacagttctgtgtggatttgtctgattgcttcagacatgtaatgttgtttttcatccttggcagcttacatcagttgtttgtttgattagaaaaatgaagcagacacacacacacacacacacacacacacacacacacacacacaaacatataacctatgccaataaaaatgtctcagcaacagtggaattcaccttggtgtttctctctgtaatttgtgtggggtttacccctcacaggtttaagagaccaggtcttgtttctctctctgtgctaccaagaagatgtgaacctgaggatgcatcttgtttcataagaaggaaggcaggtgaatatgtggtttctaacgaggtcttgttgaaataacgggctgccctcagctcacagaaataccacagctcagccactgtgatgcagagccccaggggtctttgccagacaacttgtcctgactcaacagagacggcagcctgacctttgagctggcttgtccaggcattcaggttgcttgcgtagacttccagggaagcaagcctgtccttcctgacccggcggttaacctggtgcacttttgttcctttgttaactgttgtgttgtcactaaactgaaaggctggggcttgcccttagacgtcacattggctctgtccctgtggcgatggcagggcagggtggccaaacaggtcaggtgcttgttctgtcctcttgccttttacttaaattcctctgacttttaaaaatggtgacactcttatcgtaaagcttcttatttttctccactgcttggatatgaaactgtagagggagaggccctgttgcccagtgttctcctggtttagcagctgaggtgactgcagtctgatgtgatgtaactgtttccctttgattctccagtattcctgtttccatccagttccttactctcctctttcctcttccctcgcatgtctccctccagtcctctgtacctagaatagtctcactgtcccccgtttgcctccacgagcctgctgtttccaggaaattacataacgttcagttgggatggaaatcttccggaggacgaatagagtttaattactcattgcgtcggaaagccaagccatttctgtctccagagttgttctcttaaactgatatgagttct

SEQ ID NO: 65655 - DNA, 2139 bp, Homo sapiens
ggccttcgtccctactgcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgtggtggcacaaaggctgaggaagctagaatttcctgtgaaggacagtggagaacccagtgtccctcgggctgacaagaaccacttcccaagacccacagtgcctggagaggacatggggaagggaccagtgtatcagttgcgtggagatactagagacacacttgcccagctgggaattgcagagctagtgcatttctcccaaagcacagactaataccccagatttaaaaaaagaacataaaaaataaagtaccacacatattgcacaaaaaaaaaaaaaaaa

SEQ ID NO: 65656 - DNA, 1332 bp, Homo sapiens
atggttccaatgggcccaggtacagctcaggctgctgctgtggagggtagaagctgtaagccttggtggcttccatgtggtgttaagcctgtggatatgcacagtgcaagagtgaaggaggcttggaagcctctgcctagagttaagaggatgtatgagaaggcctgggtgtccaggcagaagcctgctatagggggatttgagctgaaccaaagcatcaacaccaatcagactgtttccgaagaactagagttttctgggtcagcaatggaaagcctcagagggaatactgctcagggtcctacaaatgaagaagactataaaaacgaaggccaattatcaaggcaaacaaaatgtcctgcacagaagaaatcctcttttgagaacacagtggtcagaaaagtgtcagtgacactcaaagaaattttcacaggggaggaaggccctgaatccagtgaatttagtctaagcccaaaccttgacgcacaacagaaaattccaaagggacatggatccccaatatctaggaaaaactccaaagataattcagacttaattaaacaccaaagacttttctcacaaagaaaaccttgtaaatgcaatgaatgtgaaaaagcctttagttaccaatcagaccttcttgtacacagtagaattcatggtggagaaaagccttttgaatgcaacaaatgtgggaaatctttcagccgaacctttagccgaagcactaaccttagtcagcatcagcgaactcatactcaagaaaggccttacaaatgtaatgaatgtgggaaagccttcggtgaccgttcaaccataattcagcatcaacgaatacacactggagagaatccctatgaatgcagtaaatgtggaaaagctttcagttggatctcatcgcttactgaacatcagagaacacacactggggagaacccctatgagtgcagtgaatgtgggaaagtgttcagtcgaagctcgtctcttacagaacatcagagaatccacagtggagaaaagcctcacgagtgtagagtgtgtggaaagggcttcagtcgaagctcatcccttattattcatcagagaactcataccggggagaagccgtacaaatgtaatgactgtggaaaagccttctgtcagagttcaactctgatcagacatcagcaccttcatactaaagagtgcttcagcgccttctccacacttgcgggggacccatccactgcctcccatgtttccactgaagcccatcctcgcagcacagctgccactggctaccacagcccatgctgcagccacatagccaacccaggaaccctcaggggctga

SEQ ID NO: 65657 - DNA, 1332 bp, Homo sapiens; identical to SEQ ID NO: 65656

SEQ ID NO: 65658 - DNA, 1715 bp, Homo sapiens
gccccgcagaggacttgcctccaccgccacctgcaagtccgcccagctgtacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccgggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagaaaaaaaaaaaaaaa

SEQ ID NO: 65659 - DNA, 2010 bp, Homo sapiens
gccccgcagaggacttgcctccaccgccacctgcaagtccgcccagctgtacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccgacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaaa

SEQ ID NO: 65660 - DNA, 1354 bp, Homo sapiens
agcggactgggagcgccttccggagagacgcagtcggctgccaccccgggatgggtcgctggtgccagaccgtcgcgcgcgggcagcgcccccggacgtctgccccctcccgcgccggtgccctgctgctgctgcttctgttgctgaggtctgcaggttgctggggcgcaggggaagccccgggggcgctgtccactgctgatcccgccgaccagagcgtccagtgtgtccccaaggccacctgtccttccagccggcctcgccttctctggcagaccccgaccacccagacactgccctcgaccaccatggagacccaattcccagtttctgaaggcaaagtcgacccataccgctcctgtggcttttcctacgagcaggaccccaccctcagggacccagaagccgtggctcggcggtggccctggatggtcagcgtgcgggccaatggcacacacatctgtgccggcaccatcattgcctcccagtgggtgctgactgtggcccactgcctgatctggcgtgatgttatctactcagtgagggtggggagtccgtggattgaccagatgacgcagaccgcctccgatgtcccggtgctccaggtcatcatgcatagcaggtaccgggcccagcggttctggtcctgggtgggccaggccaacgacatcggcctcctcaagctcaagcaggaactcaagtacagcaattacgtgcggcccatctgcctgcctggcacggactatgtgttgaaggaccattcccgctgcactgtgacgggctggggactttccaaggctgacggcatgtggcctcagttccggaccattcaggagaaggaagtcatcatcctgaacaacaaagagtgtgacaatttctaccacaacttcaccaaaatccccactctggttcagatcatcaagtcccagatgatgtgtgcggaggacacccacagggagaagttctgctatgagctaactggagagcccttggtctgctccatggagggcacgtggtacctggtgggattggtgagctggggtgcaggctgccagaagagcgaggccccacccatctacctacaggtctcctcctaccaacactggatctgggactgcctcaacgggcaggccctggccctgccagccccatccaggaccctgctcctggcactcccactgcccctcagcctccttgctgccctctgactctgtgtgccctccctcacttgtgggccccccttgcctccgtgcccaggttgctgtaggtgcagctgtcacagccctgagagtcagggtggagatgaggtgctcaattaaacattactgttttccatgcaaaaaaaaaaaaaaaa

SEQ ID NO: 65661 - DNA, 2989 bp, Homo sapiens
aggggagaccagggttgtttaccagcaggacagagcccgggcgcaggcggcggatggagcggaacggctaggggtcttgagaagcaatggccacagaagcccctgtgaatatagcaccacctgagtgtagcactgttgtcagcacagcagttgacagcctcatttggcagccaaactcactaaatatgcacatgataaggcccaagtccgccaagggacggacaagaccgagtctgcagaaatcccagggcgtggaggtgtgcgctcatcatataccatctccgcctccagccattccctatgagttgccaagcagccaaaaaccaggagcctgtgcacccaaatctccaaaccagggagcttctgatgagatccctgagctgcagcagcaagtacccactggggcttcctcttctctcaataagtatccagtccttccttccatcaacagaaagaacctggaggaggaggctgtggaaaccgttgccaaaaaggccagctcactgcaactgagcagtatccgggctctttaccaagacgagacgggcaccatgaagacaagtgaagaagattccagagctcgagcttgtgccgtggagaggaaattcatcgtccgaaccaagaaacagggctcttccagggctggaaatctggaggaaccatcggaccaagaaccaaggttgctgcttgctgttagatcaccaacaggccaaaggtttgtacgccatttccggccaacagatgatttgcaaaccattgttgctgtggccgaacagaaaaacaaaacctcctaccgacactgcagcattgaaacaatggaggtgcccaggaggcgattttctgacctcaccaaatctctgcaagagtgcagaatcccccacaagtctgtgctgggcatctcactggaagatggggaagggtggccctgagtccacagccacccagctgaggtcctgggtctctgagcaaaggagcatgcttgggcgttgtggcctcttaggcagcctgtttcaagtgccatgtggacctggtgcagctgggaagcttgggactctcgtctgcactgcgtgtcctctgaagcagtgaagtctgtgcctatgccgagcgcgctaagaagtctcccttccagctgttccattctctccaccaccagcgtaactggcaagttaccaaggttgttcctgaaacagcagtgatcatgacttctcctttccagagttttgggtccttctgaattaatggtccttttcgaacaccggcttgcctttacagtgaactgtgattctctcgaagccaatgctttcctgtctgtatttgatgcaggattaaacacttcccagagaggattctagtctggtaaataaccacagtgtaggaactatctaactggcatttgtgtttcttgcgagtattttgaagaaacaggccgttgaccccatctttggaagtagccctttaccatgcatggtcagtttcttagggatttactatttgtgtgaggtggcatctaagggaagaatgggttttcttccccaaaacatcagcatttctaaaatagtcctaaagcttgaaagtaagttgcttccatgagcatggattacccagtagctactttttaatagagactgactaggtttacaacttctgggagctactctgtgggctgaattcttccaaaaccgagaaaagccagtgcagtctgatttcttttgcttttgtcagtaatggaatcttttgtttttaaaatgtacaaacctataagtttaaacaggtttgtactgacaacctccttggcttatttgggggtggagcaattgttttattccccagtttcagtgcgttgcccacttcaaacatggtgtgtcctttggagctgtgacagaggtgcctgttctgacttagaacctctggaggaggaggggggtgccttggtctcgtgttactttgctgtgcctgtgctgagagaccatgtgcccgagcatctggttgaccggcatgaagtacatcagcctgtcttagcctgagctgctttgaagaccatggggtcttgtgtttccaacttcgaagtgctgatgtggacagtttgccaatgttctcttctattgcaagttcagccagactccatgactcatctgatcccttttatggccaaatcatccttcagagtagggaacactcagacattctgtgcatgttgttcccccaaagcatggtcatcacaaagtcctgagttctggtgtgtgctcccgcctcctgggtatacagagagaaggcaggaatcaggagttccagaagcatatacatgtggctaccccagcaacaagcgcatcctgtgctcagataagctgcatggttgggagtgttttttctcgcacgttgaggcttagtggagatgggcaccactgccatttgctcagaagaaggctggtctggtcctaactgcatcccacactgcccagatcattctagaataggttatttctgaatgttttatagaatttcttaataccatcctggtttggtcagccattcctttgattggaaaggtcagctggggccagtggtgcctcaggcaggcccacacaactggccacctcttcccgttaatgaccacagcagacagaatttgagcccagcacctaaaagtacaggaatttcacttcccaccaggacttgagcacataactctatgtctgatctaggaggctgggggaagagcctcccataaaatcacacctactctgtggtaagaataaaatcccacccacctgggacttggtaatttctccaaacaggaaagctttagaaaacttgagtgaaatggagcaagcttgaaggagttagaatcttctgtgcttagggtttgctgctgctggtgagcttagaattttggggttgggaaaaagtggaaggcataagcatagaaatattttaggatattttaggatatgtgaataaagctagactcaaaccaaaaaaaaaaaaaaaa

SEQ ID NO: 65662 - DNA, 2988 bp, Homo sapiens
gtcgcaggaacctcttgtgagccacgagcagatgcaggtgttccagatgatcaccaagtcccagcggatcttctcccatgcccaggtggcagcagtctcctcccagctccctgcgcccgagggcaaaccagccgccctgaggccgctgcaggggccgtggccgcagcagcccccaccactggctcctgctgtggactctctccacgccggccctggaaaccccgaggcagagggctccccagcccgcaggagaaaaaccacacccggggttcccagagaggcctcccccggcagcacgagacgagacgcaaaggggggactgaaagtggccgcggttccaacgccccttgcagcaccgtctctggacccttccaggaatccagacatctcttctctggccaagcagctgcgatcctctaaagggaccttggacctggaggacatcttcccctccacaggccaacggcagacccagttaggtggggaggagccaccaggagcctcgctgccagggaagcaggccccagccgagaatggcgcggcttcaaggatcacaaaaggtgaaaagggcccagcctgctcccggggtggaggctaccggctcttgggcaaccccagggccccgcgattctccggcttccggaaagagaaggcgaagatggatatgtgctgtgcggcttctccgagccaggtagccatggcctccttctcatcggccgggcccccggcagatccctccaagtccaagctgacaatattcagcagaatccagggtggaaacatctacaggctcccccatccggtgaaggaagagaatgtggcaggcagaggtaaccagcaaaacggcagtcccacagactggacgaagcccaggagcacttttgtctgcaagaactgcagccagatgttttatacggagaaagggctgagcagccacatgtgttttcacagcgaccagtggccgtcacctcgagggaagcaggaaccgcaggtgtttggcacagagttttgcaagccgctaagacaggtgctgaggccagaaggggacaggcatagtcccccaggaaccaagaagcccttggaccccacagctgcagcccctttggtggtcccccaatcgatccccgtggttccagtgacccgacacatagggagcatggccatgggacaagagaaagacggggaggagcgagacagcaaggagagcagccagcagagaaagcggaagaagcggcccccaccctccacggctggggagcctggccctgcaggatgccaccagagccgcctgcggtcacccatgttcctggtggactgcctcctgaagggcttattccagtgctccccctacacaccacccccaatgctcagccccatccgggagggctctggggtgtacttcaacaccctctgttccacgtccactcaggccagccctgaccagctcatcagctccatgctcgatcaagtggatgggtcctttggcatctgtgtggtgaaggatgacaccaaaatcagcattgagccacatatcaatataggaagccggtttcaggcagagatcccggaactccaggagagatccctggctggaactgacgagcatgtagcttctctggtctggaagccatggggagatatgatgatcagctcagagacacaggatagagtgaccgagctctgcaatgtggcatgctccagcgtgatgccaggagggggcaccaacctggagctcgctctgcactgcctgcacgaggctcagggcaacgttcaggtcgccctggagactcttctgctccgagggccccacaagccacggacacacctgctcgctgactatcgctacacaggttcagacgtctggacccctatagagaagaggctttttaagaaggcgttctatgcccacaagaaggacttctacttgatacacaagatgatccagacaaagacggtagctcagtgcgttgagtattattacatctggaaaaaaatgatcaagtttgactgtggccgagccccagggctagaaaagagggtcaagagagagccggaggaagtggaaaggacagaggaaaaggtcccatgcagccctcgggagagacccagccaccatccaactcccaagttaaagaccaagagttataggagggagtccatcctcagctccagcccaaatgcaggctccaagcggacccccgagctgttgggaagtgcagagagccagggcatttttccatgcagagagtgtgaaagggtgtttgacaagatcaagagtcgaaatgcccatatgaagcggcaccgccttcaggaccacgtggagcccatcatcagggtgaagtggccagtgaagcccttccagctaaaggaagaggagctgggagctgacatcggccccctgcagtggtgactcccgtggcagcaagtccgaatggggcctccagtgctgcccctcctcccttcggcctctccagggcgtttggggcacccctctgcctccccccaccctccctgtcccctgttggccaacctgcctgcaaacatggagggcatttggccacagataggcaggaggagctcagttgtcggacagctatgcagtccctgtccggtggtgctggaggctccactctccttaggttcatagtctctccccttctttcccttccacttctagagcagggaggcttggggaggggaaaatttagctctgggtagctcttaaatcttagcctcagttgtggggtttggtttcatgtgttagataaggccaagacttagagaatcagtgggaaaaaaccttgagatctccaacacgctgggcccctccctggggcggggactctaccttccagattcagtccctagtcttgcgatgaattctgcattgttcggtgttttttgtacatgtcaactcgtaaatctgattaaattgggttcttgaaaaaaaaaaaaaaaaaaaaaaaaaaaaaaaaaaaaaaaaaaaag

SEQ ID NO: 65663 - protein, 518 aa, Homo sapiens
MTSSKIEMPGEVKADPAALMASLHLLPSPTPNLEIKYTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 65664 - protein, 480 aa, Homo sapiens
MTSSKIEMPGEVKADPAALMASLHLLPSPTPNLEIKYTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 65665 - protein, 422 aa, Homo sapiens
MDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 65666 - protein, 221 aa, Homo sapiens
MAGTGLLALRTLPGPSWVRGSGPSVLSRLQDAAVVRPGFLSTAEEETLSRELEPELRRRRYEYDHWDAAIHGFRETEKSRWSEASRAILQRVQAAAFGPGQTLLSSVHVLDLEARGYIKPHVDSIKFCGATIAGLSLLSPSVMRLVHTQEPGEWLELLLEPGSLYILRGSARYDFSHEILRDEESFFGERRIPRGRRISVICRSLPEGMGPGESGQPPPAC

SEQ ID NO: 65667 - protein, 308 aa, Homo sapiens
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVTYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 65668 - protein, 1404 aa, Homo sapiens
MTRMSCPWGSYQWEPGACPAAPRGIGGGDMAGGIPDVRGLQEAALGAGRSQEEARLVEEAQTPVMLPQDSGQRVEEVPGDLMAKRMSLILHVQKLPWDHVPCLRRTRQNLYQDVGGHAHGSGLGGAKRGAARSALRRPLPPATCRPAGIVSGPSPRLDSNPTGAHLIKQTRPLTVEWTKDTPVPEPMELRSDASHKENVSPKPAALPKPGKRLKQRRFRRSLGIGLSGRHDQWVPGCQVERGGPAATPSPGAVLDQEPCRVQTNLASPGPRLGLALKDTTGQLVNSSFWQQSNLQSLARRRQGKAREFAIQQSNLSINETSSPHLCPEPGGSSGPHKLPWGPLLSQEPLARPSSCLRQSGLPAPGTPSGDFRPTEAFAPLDGHTQPGLRSWGGLGSWRSRLVGEPLTLEDLAVPSQNQTQAPSRAAVHQLLASVHCLAQEAARLSWQLLSRCFRSWRHLVKRQREPAAAAVALGRWQLLRKCLQALWLREAQLEAAWGQYTKVLLVRSFREVSGLQVGPGGRVKQCPGSLREEEIAQRLLSHPRQRTDSRHERVQILQALQLAVFFLWCQQKKRARQERETLRKATRATQRTGSFPQAWHSTAAGVAWVAPLSPQHQRAWLCRCFGAWQQFVQRGSRYRDHLADRRTGTLRKCLEQWVRMKQLRESDGAKVTQLSLCRQKAGREAVYTAGPGACGLGAVGQAQGQQEQGRGSLQDACWTLALCWALLLWKMRLFQRQWANSFFQGLQQRMLQRSLRWWHLRALGPDATSSCTKTPSALEPLSSSTLQDSLEKVPRAPTLPDTLQGSLLWAAGQRQQGQCLLLWQARAQQFQGTARWYQHTRQRRIFLSWSRWATAQWAWRELASHRAWDRTCRAVLGLWRQRLLQSRLVEWWAQERGWRLARDALCHWHSCWQGQQFLHEKCQTWVQVHLQGLQKVVFRSWQQAAAHQRCTVTRPEQLLLQSYFQAWCEVVRDTGVLRAQHQAFQDGLRRRALGAVFATWREAQEVAAGAQEQRVAQASLARWRSCGQQGQEDGQQKKARAPQAFPAWPVAPGMHHEAQQQAGESAGAQAAQCWTWCWALWVHESCRGQVSRAHASWKPRAWVLEASVQSAVRGGVQRAILTQLRPAELRRFLRTVQLRVRLGLPGAGKTRSCWTQATELVPPAPSLQCSLGGRRKPRGTAWAQRCREHSLCPAFQLWPQWPGQSSWVPGLPLWTRDQGPRAHSSPEPRACKAQSKAHKRRLRILEKQAQAHGSALLLALKGHDALGHQEEVPAAPVPRGTASRAAGFPAGQVPGSGMAALGGCPRGRAAGADPAQGVAPEMGLADVVAADPATASGSAVTAAGRWAFKKWHQRLAARSPRRGAASSPRPWSKPGPKGPESGQEAARAPRGWGLGAEHGAQLQL

SEQ ID NO: 65669 - protein, 1404 aa, Homo sapiens
MTRMSCPWGSYQWEPGACPAAPRGIGGGDMAGGIPDVRGLQEAALGAGRSQEEARLVEEAQTPVMLPQDSGQRVEEVPGDLMAKRMSLILHVQKLPWDHVPCLRRTRQNLYQDVGGHAHGSGLGGAKRGAARSALRRPLPPATCRPAGIVSGPSPRLDSNPTGAHLIKQTRPLTVEWTKDTPVPEPMELRSDASHKENVSPKPAALPKPGKRLKQRRFRRSLGIGLSGRHDQWVPGCQVERGGPAATPSPGAVLDQEPCRVQTNLASPGPRLGLALKDTTGQLVNSSFWQQSNLQSLARRRQGKAREFAIQQSNLSINETSSPHLCPEPGGSSGPHKLPWGPLLSQEPLARPSSCLRQSGLPAPGTPSGDFRPTEAFAPLDGHTQPGLRSWGGLGSWRSRLVGEPLTLEDLAVPSQNQTQAPSRAAVHQLLASVHCLAQEAARLSWQLLSRCFRSWRHLVKRQREPAAAAVALGRWQLLQKCLQALWLREAQLEAAWGQYTKVLLVQSFREVSGLQVGPGGRVKQCPGSLREEEIAQRLLSHPRQRTDSRHERVQILQALQLAVFFLWCQQKKRARQERETLRKATRATQRTGSFPQAWHSTAAGVAWVAPLSPQHQRAWLCRCFGAWQQFVQRGSRYRDHLADRRTGTLRKCLEQWVRMKQLRESDGAKVTQLSLCRQKAGREAVYTAGPGACGLGAVGQAQGQQEQGRGSLQDACRTLALCWALLLWKMRLFQCQWANSFFQGLQQRMLQRSLRWWHLRALGPDATSSCTKTPSALEPLSSITLQDSLEKVPRAPTLPDTLQGSLLWAAGQRQQGQCLLLWQARAQQFQGTARWYQHTRQRRIFLSWSRWATAQWAWRELASHRAWDRTCRAVLGLWHQRLLQSRLVERWAQERGWRLARDALCHWHSCWQGQQFLHEKCQTWVQVHLQGLQKVVFRSWQQAAAHQRCTVTRPEQLLLQSYFQAWCEVVRDTGVLRAQHQAFQDGLRRRALGAVFATWREAQEVAAGAQEQRVAQASLARWRSCGQQGQEDGQQKKARAPQAFPAWPVAPGMHHEAQQQAGESAGAQAAQCWTWCWALWVHESCRGQVSRAHASWKPRAWVLEASVQSAVRGGVQRAILTQLRPAELRRFLRTVQLRVRLGLPGAGKTRSCWTQATELVPPAPSLQCSLGGRRKPRGTAWAQRCREHSLCPAFQLWPQWPGQSSWVPGLPLWTRDQGPRAHSSPEPRACKAQSKAHKRRLRILEKQAQAHGSALLLALKGHDALGHQEEVPAAPVPRGTASRAAGFPAGQVPGSGMAALGGCPRGRAAGADPAQGVAPEMGLADVVAADPATASGSAVTAAGRWAFKKWHQRLAARSPRRGAASSPRPWSKPGPKGPESGQEAAGAPRGWGLGAEHGAQLQL

SEQ ID NO: 65670 - protein, 549 aa, Homo sapiens
MGNLKAMEKMADALLFGNFGVQNITAAIQLYESLAKEGSCKAQNALGFLSSYGIGMEYDQAKALIYYTFGSAGGNMMSQMILGYRYLSGINVLQNCEVALSYYKKVADYIADTFEKSEGVPVEKVRLTERPENLSSNSEILDWDIYQYYKFLAERGDVQIQVSLGQLHLIGRKGLDQDYYKALHYFLKAAKAGSANAMAFIGKMYLEGNAAVPQNNATAFKYFSMAASKGNAIGLHGLGLLYFHGKGVPLNYAEALKYFQKAAEKGWPDAQFQLGFMYYSGSGIWKDYKLAFKYFYLASQSGQPLAIYYLAKMYATGTGVVRSCRTAVELYKGVCELGHWAEKFLTAYFAYKDGDIDSSLVQYALLAEMGYEVAQSNSAFILESKKANILEKEKMYPMALLLWNRAAIQGNAFARVKIGDYHYYGYGTKKDYQTAATHYSIAANKYHNAQAMFNLAYMYEHGLGITKDIHLARRLYDMAAQTSPDAHIPVLFAVMKLETTHLLRDILFFNFTTRWNWLKLDNTIGPHWDLFVIGLIVPGLILLLRNHHG

SEQ ID NO: 65671 - protein, 387 aa, Homo sapiens
MGIKVLQQSKSQKQKEEAYLLFAKAADMGNLKAMEKMADALLFGNFGVQNITAAIQLYESLAKEGSCKAQNALGFLSSYGIGMEYDQAKALIYYTFGSAGGNMMSQMILGYRYLSGINVLQNCEVALSYYKKVADYIADTFEKSEGVPVEKVRLTERPENLSSNSEILDWDIYQYYKFLAERGDVQIQVSLGQLHLIGRKGLDQDYYKALHYFLKAAKAGSANAMAFIGKMYLEGNAAVPQNNATAFKYFSMAASKGNAIGLHGLGLLYFHGKGVPLNYAEALKYFQKAAEKGWPDAQFQLGFMYYSGSGIWKDYKLAFKYFYLASQSGQPLAIYYLAKMYATGTGVVRSCRTAVEKRLTFLKKRRCIQWRFSYGIELPFKAMHLLE

SEQ ID NO: 65672 - protein, 549 aa, Homo sapiens; identical to SEQ ID NO: 65670

SEQ ID NO: 65673 - protein, 387 aa, Homo sapiens; identical to SEQ ID NO: 65671

SEQ ID NO: 65674 - protein, 137 aa, Homo sapiens
MKDKMWCEDTAQPHRRLPAPPSSSSPTVVFQPHRRLLAPPSSSWTLWVAPRCGCCSPLCPKRVCASLCRVLAVTWSLTKLPFPLSPILLSRPGWLPQPSSPGPACAEPSSQEGGDTDLRSYGCFVCGWAWPTLSPRP

SEQ ID NO: 65675 - protein, 161 aa, Homo sapiens
MEYTGSKYIGEYVDGRMEGKAKYILPTETIYVGEMKDGMFHGEGALYFPSGSQYDAIWENGLAIKGTYTFSDGLHYDEKNWHYCDGYDRRFYTEILNGLKPAGMAQLTNMDPPRKIPKGYYDCGDGFYNPVTRVVKDYRNRFLRNADDDEHEWITRTCRKG

SEQ ID NO: 65676 - protein, 465 aa, Homo sapiens
MLGSMARKKPRNTSRLPLALNPLKSKDVLAVLAERNEAIVPVGAWVEPASPGSSEIPAYTSAYLIEEELKEQLRKKQEALKHFQKQVKYRVNQQIRLRKKQQLQKSYERAQKEGSIAMQSSATHLTSKRTSVFPNNLNVAIGSSRLPPSLMPGDGIEDEENQNELFQQQAQALSETMKQARHRLASFKTVIKKKGSVFPDDGRKSFLTREEVLSRKPASTGINTGIRGELPIKVHQGLLAAVPYQNYMENQELDYEEPDYEESSSLVTDEKGKEDLFGRGQQDQQAIHSEDKNKPFSRVQKVKFKNPLFVLMEEEEQKQLHFEGLQDILPEAQDYFLEAQGDLLETQGDLTGIQSVKPDTQAVEMKVQVTEPEGQAIEPEGQPIRTETQGIMLKAQSIELEEGSIVLKTQDFLPTNQALLTKNQDVLLKDHCVLPKDQSILLKYQDQDFPPRDQHVLHKDQDILP

SEQ ID NO: 65677 - protein, 2916 aa, Homo sapiens
MRLDEITKSENEDGEKKMFTQQFESTDACVYEVYVKINSIVKSQSQCGLKRGSPETELWGAIVFRSQEENAKPVKETEVTASDADSGLYGFIEYSLYDGFLSYEAPQAFRIDPHDGQICVSQDIDRERDPATYDLLVEAKDGDEQRMTHLALVKGGLSAQAFVRVDLEDVNDNHPVFNPSTYVTSISDETQPGTEIINVLATDQDSGIYGTVAYELIPGNVSSLFTIDSTTGLYSPEVEILSAVNFSADKEVMNSLEMFLPLLRHFKKVERDEEAAEKKFEASRGWFMRFKGRRHLHYLKVQDEAASADGEAAARYVANLAKILGEGIIYLTLPLSHLESTTLSLMVSAQDGGGLTAVINADVTIHIFQTTLAPAEFERPKYTFLVYEDVPEDSPIGTVKAREPLNSSEPIFYRISSGDLGGKFSIHPRLGTIRTRKPLDHETQPVVVLTVQAQLGSAPACSSTEVNITVMDVNDNHPAFLRTSDEIRISQTTPPGTALYLARAEDRDSGRNGLIRYSIASPQPGVFAIDRALGVLFLNGSLGAGEQRELTLTLRAEDQGVHPQAALLVLTVVIEKREHSPSWTFEHLVYQVEVSESLSPMTQMLQTQAHPLGPQRAASPLRYSLEPSVDSAMFGIRPYTGWIYLRRQFDYESTQTYNFRVFAWIPEDGFLQNVSTTVIVRVWDENDNSPTFLHDVLFLKVEESPVPQGVIGKITAIDMDSGKNGQLLYFLLSDGKFFKMNPNTGPAGTIYVITWADGAAAFSGTDFAFSSDELQAFVLKSLFCELGEGELINWVALDREHRGHHEMTVLVTDRGSPPRNATMAVYVSVTDINDNRPFFPQCLPGKELHVKVLEGQPVNMLVTTVFAKDPDEGNNAEVTYSVSSEDSSDHFKIDANNGEIRTTTILSYDYRPSYRMSVIATDQGVPPLQGQAVVNIQVIPLSKGRAIMSQNIRHLIIPENLKPTKIMSLIKSSDHLQQHYNGKLHFSIVADDKDGHFEIDSSTGDLFLSKELDYETTSHYLFRVITTDHSKNLSLSSTVFLSIDVEDQNDHSPSFQDELIVISVEENVPIGTLVYVFNAKDDDGSFLNSRIQYYIESHNPGTNPFLIHPSFGTLVTVSRLDRESIPTVILTVTASDQAVNVTDRRLRSLTAQIVILDVNDHNPTFISFPNAHVKEDVTVGSLVHHITAHDPDEGRNGKVTYSILSGNENMTFMLDESSGLLTTTCPLDYEMKTQHILTVLALDDGTPALSSSQTLTVTVLDVNDEAPVFKQHLYEASVKENQNPGEFVTRVEALDRDSGVNSKLQFEIMPGASFELFEINSDTGEVVTTTILDREIQEVFTLRVLVRDGGFPSLSSTTTILCTVEDENDHAPEFIVSSYDIEVLENQEPEVVYTVLASDMDAGNNRAVEYHIIDGNTDECFTINEMSGELSTTRALDREQISNFTLVILCSDLGDPPRSSVIHLQVRVLDANDHSPSFPTLYYQSSVREDAEVGTVVLVLSAVDKDEGLNGQTEYFLTDEASGAFTIDPMSGTLKTSNTLDREARSQHTFSAVARDCSIQGSRSTTVIIKVYVTDVNDNDPVLEQNPFDVFLSPESPTNQTTVIVRADDLDLGPNGTVVFSFAETQSMFSIDKYTGEIQFQQNPSSEYFPIWLQLKVTDQGIPARTTTGLLVIHMEGEDVKISFSHHLYKGLVTENCEAGTSIVTVKAFAPDSIQDSMKYSIFSGNEDGVLSLCSKSGQLTVKEPKFLDFEVRNEVQLIVLAESSGHRAYCKVAVLIQDENDNSPCFEQSIYQASVSESQLYNAHVIQVFATDLDSGLNGLIEYSILSGNQEEAFQIDALSGVITTKAILDYELTSSYSLIVQATDKGMPRLSNTTVIKVQVTDINDNAPAFLPSEAVEITEDSLPGVIVTHVSVHDVDLNSAFIFSFAKESNPGTKFAIDQNTGVVVLVKTLDFEEMTEYELLIQISDSVHYTEGALVVRVLDVNDNPPVFSQDFYQVTVPESIPVGYSVLTLSATDLESNENISYRILSSSKEFSIDPKNGTIFTISPVLLLDTISTTQFLVEASDGGNPDLRALTLVEIGIEDMNNYAPEFTVKSYNLSLSEDALVGSTLVTFSNIDHDWTRENTYVEYSIISGNSQNNFHVETKFFHSEYPYKQVGYLVLLHSLDREASASHELVILASDSGCPPLSSTAVISIQVLDVNDNPPNFSSLSYHTHVKESTPLGSHITVVSANDRDTGSHAEIIYNIISGNEKGHFYLEENTGVLYLIKPLDYEKMTKFTLTVQASDAEKKHFSFAVVFVSVLDDNDHAPQFMFSSFSCIVPENLPISSTICSINALDFDAGPYGELTYSIVSPCFLTHGMSYDHDLFLIDPLTGDIHAKQILDYENGNKYCLTVQAKDKGDATASLVVWVDIEGIDEFEPIFTQDQYFFTLPEKNKDRQLIGRVEASDADAGIDGVILYSLGTSSPFFSVNKTNGNIYLIRALPLIKSQLNKEDTLEMKIIAHSPKSDSKFASCTVFVNVSFSSEGTPLAVFASSFSISLVVSFLVFLILICILIVMILRHKQKDTINNYEEKKTSSLDADLRVTRDASVLKAFQKTDDCSNEVVPVDATPEWLSLISIMEKDIVNLYRHSNSSGHCSVEGETAEDKEIQRINEHPYRKCSDSALSDHESRVPDSGIPRDSDQLSCLSGETDVMVTAETAEASQTFGEGDQGEGCSTTCAQNNVLPQTVQKREAKESILADVRKESVFISGDQEVRCAALSTQTTSDHDGKDNYHWNYLLSWEPKFQPLASVFNDIAKLKDEHLHMPGIPKEKKSFVFPPPLITAVAQPGIKAVPPRMPAVNLGQVPPKHPRSPIPYHLGSLPEGMTPNFSPSLSLLTMQPPALSPLLREGELLGTHISGTCHELKAEDEVQI

SEQ ID NO: 65678 - protein, 793 aa, Homo sapiens
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLDGLVNVGWMDCATQDNLCKSLDITTSTTAYFPPGATLNNKEKNSILFLNSLDAKEIYLEVIHNLPDFELLSANTLEDRLAHHRWLLFFHFGKNENSNDPELKKLKTLLKNDHIQVGRFDCSSAPDICSNLYVFQPSLAVFKGQGTKEYEIHHGKKILYDILAFAKESVNSHVTTLGPQNFPANDKEPWLVDFFAPWCPPCRALLPELRRASNLLYGQLKFGTLDCTVHEGLCNMYNIQAYPTTVVFNQSNIHEYEGHHSAEQILEFIEDLMNPSVVSLTPTTFNELVTQRKHNEVWMVDFYSPWCHPCQVLMPEWKRMARTLTGLINVGSIDCQQYHSFCAQENVQRYPEIRFFPPKSNKAYHYHSYNGWNRDAYSLRIWGLGFLPQVSTDLTPQTFSEKVLQGKNHWVIDFYAPWCGPCQNFAPEFELLARMIKGKVKAGKVDCQAYAQTCQKAGIRAYPTVKFYFYERAKRNFQEEQINTRDAKAIAALISEKLETLRNQGKRNKDEL

SEQ ID NO: 65679 - protein, 434 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 65680 - protein, 375 aa, Homo sapiens
MIRTNFFLKQGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 65681 - protein, 202 aa, Homo sapiens
MDAQEALARRLERAKKLQEQREKEMVEKQKQQEIAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 65682 - protein, 366 aa, Homo sapiens
MVLHLLLFLLLTPQGGHSCQGLELARELVLAKVRALFLDALGPPAVTREGGDPGVRRLPRRHALGGFTHRGSEPEEEEDVSQAILFPATDASCEDKSAARGLAQEAEEGLFRYMFRPSQHTRSRQVTSAQLWFHTGLDRQGTAASNSSEPLLGLLALSPGGPVAVPMSLGHAPPHWAVLHLATSALSLLTHPVLVLLLRCPLCTCSARPEATPFLVAHTRTRPPSGGERARRSTPLMSWPWSPSALRLLQRPPEEPAAHANCHRVALNISFQELGWERWIVYPPSFIFHYCHGGCGLHIPPNLSLPVPGAPPTPAQPYSLLPGAQPCCAALPGTMRPLHVRTTSDGGYSFKYETVPNLLTQHCACI

SEQ ID NO: 65683 - protein, 95 aa, Homo sapiens
MVVIDVKMLSGFTPTMSSIEELENKGQVMKTEVKNDHVLFYLENGFGRADSFPFSVEQSNLVFNIQPAPAMVYDYYEKEEYALAFYNIDSSSVSE

SEQ ID NO: 65684 - protein, 87 aa, Homo sapiens; identical to SEQ ID NO: 62936

SEQ ID NO: 65685 - protein, 136 aa, Homo sapiens
MGGSLCCCGEGEGFFYRQNWRFLSLDSWDLIQAAHSTHSAIQLYSMHSGISHLLRKDLSFEKVARDPLLRRLRRNTRDDSDTQQLKAEVQAEEKGVKPVAAELPGESSEQVIAIVEVSSRLYFGAITSSTVSCLVS

SEQ ID NO: 65686 - protein, 127 aa, Homo sapiens
MTGLLSPLPIGGWSPGPRETCDPRCRRENFSPEGKSALRDPAPLPSSATDPERSYRMILETAHFRNHVAGVVHWIHHSRLKLTTQDKWTSQQDPDHPTRLILRRDQTAAEDDRPVLVTPEANQPTHG

SEQ ID NO: 65687 - protein, 136 aa, Homo sapiens; identical to SEQ ID NO: 65685

SEQ ID NO: 65688 - protein, 447 aa, Homo sapiens; identical to SEQ ID NO: 32279

SEQ ID NO: 65689 - protein, 127 aa, Homo sapiens; identical to SEQ ID NO: 65686

SEQ ID NO: 65690 - protein, 773 aa, Homo sapiens
MSSPAVARTSPGGSREMAPAPQGRGRFWEVGGGSGHRLERAAAESERWELLLRRGELLALGGHLKGALEAFAAALRRGAPARPECLGALVDCLVFNYRLRHGLGWSAAPVAGADGGAGGLLRCLGCRGFLSEPVTVPCGHSYCRRCLRRELRARCRLCRDRLPPATASATDAEGTAPRPPPLAAAIAASDFRTSVVLNHLAEKWFPGQRERARAAGRLGELLHQGRYREALAAACEALRAEPSDLIVKIYRAESYAGLQEFKAAIEDLNAVLFQLPDWPEVYFRKGKVLCDAGFLGDALQLFLQCLALDEDFAPAKLQVQKILCDLLLPENLKEGLKESSWSSLPCTKNRPFDFHSVMEESQSLNEPSPKQSEEIPEVTSEPVKGSLNRAQSAQSINSTEMPAREDCLKRVSSEPVLSVQEKGVLLKRKLSLLEQDVIVNEDGRNKLKKQGETPNEVCMFSLAYGDIPEELIDVSDFECSLCMRLFFEPVTTPCGHSFCKNCLERCLDHAPYCPLCKESLKEYLADRRYCVTQLLEELIVKYLPDELSERKKIYDEETAELSHLTKNVPIFVCTMAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPEREENLQAAPNGPAWCWWLLAVLPVDPRYQLSVLSMKSLKERLTKIQHILTYFSRDQSK

SEQ ID NO: 65691 - protein, 283 aa, Homo sapiens
MAKFVIAGRADCPYYAKTELVADYLQKNLPDFRIHKITQRPEVWEDWLKDVCEKNKWSHKNSPIIWRELLDRGGKGLLLGGYNEFLEHAQLYYDVTSSMTTELMMVIAQENLGAHIEKEQEEEALKTCINPLQVWITSEWVKREFVAILKNLTTTGRQFGGILAAHSIATTLKYWYHGSPPGEIVSLGILSEGQFGIPKGIVFSMPVKFENGTWVVLTDLKDVEISEQIMTRMTSDLIQEKLVALGDKIHFQPYQSDTPRTNTLHPSIQSSWHSVLTITIRKR

SEQ ID NO: 65692 - protein, 356 aa, Homo sapiens
MDTQGPVSQPFQQPEKPGRVRRRKTRRERNKALVGSRRPLAHHDPPVAIRDPPVVPTASKLVVITQGRLSREHRGLFNHEVKSLDVARLLSSGTLVPGSPTLPAKPSPSPGRAQEPAPRSRDKENQVPGGSGPGPPSSPELSGVGQLLAELQCQLSLPQAFPRRNLIQDARDAIVHTLQACHGCVPDLALVLRGCQPPLPGAKPGVSERKMTPFWINSPDQVPEQERQRKQQGTKEFTFPMPYTSSMPTAHRGSLAPPRGPWPPYFPSLSSPSGTAWGPPTAFDLLKSIWLVATPPPPRPWGVGLPQPLPQPSSPLLPRTSVLDWSPSPPSPLPSLSWVVAQSSPEAWSFPPMRLY

SEQ ID NO: 65693 - protein, 1555 aa, Homo sapiens
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGVREEQRSPFNDRFPLKRPRYEDSDKPFVDSPASRFAGLDTNQRLTALAEDRPLFDGPSRPSVARDGPTKMIFEGPNKLSPRIDGPPTPASLRFDGSPGQMGGGGPLRFEGPQGQLGGGCPLRFEGPPGPVGTPLRFEGPIGQAGGGGFRFEGSPGLRFEGSPGGLRFEGPGGQPVGGLRFEGHRGQPVGGLRFEGPHGQPVGGLRFDNPRGQPVGGLRFEGGHGPSGAAIRFDGPHGQPGGGIRFEGPLLQQGVGMRFEGPHGQSVAGLRFEGQHNQLGGNLRFEGPHGQPGVGIRFEGPLVQQGGGMRFEGPSVPGGGLRIEGPLGQGGPRFEGCHALRFDGQPGQPSLLPRFDGLHGQPGPRFERTPGQPGPQRFDGPPGQQVQPRFDGVPQRFDGPQHQQASRFDIPLGLQGTRFDNHPSQRLESVSFNQTGPYNDPPGNAFNAPSQGLQFQRHEQIFDSPQGPNFNGPHGPGNQSFSNPLNRASGHYFDEKNLQSSQFGNFGNIPAPMTVGNIQASQQVLSGVAQPVAFGQGQQFLPVHPQNPGFVQNPSGALPKAYPDNHLSQVDVNELFSKLLKTGILKLSQTDSATTQVSEVTAQPPPEEEEDQNEDQDVPDLTNFTVEELKQRYDSVINRLYTGIQCYSCGMRFTTSQTDVYADHLDWHYRQNRTEKDVSRKVTHRRWYYSLTDWIEFEEIADLEERAKSQFFEKVHEEVVLKTQEAAKEKEFQSVPAGPAGAVESCEICQEQFEQYWDEEEEEWHLKNAIRVDGKIYHPSCYEDYQNTSSFDCTPSPSKTPVENPLNIMLNIVKNELQEPCDSPKVKEERIDTPPACTEESIATPSEIKTENDTVESV

SEQ ID NO: 65694 - protein, 601 aa, Homo sapiens
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVLALA

SEQ ID NO: 65695 - protein, 667 aa, Homo sapiens
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVVAQRLRKLEFPVKDSGEPSVPRADKNHFPRPTVPGEDMGKGPVYQLRGDTRDTLAQLGIAELVHFSQSTD

SEQ ID NO: 65696 - protein, 443 aa, Homo sapiens [sequence omitted]

SEQ ID NO: 65697 - protein, 443 aa, Homo sapiens [sequence omitted]

SEQ ID NO: 65698 - protein, 485 aa, Homo sapiens
METNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPGVSNIRTLDTPFRKNCSFSTPVPLSLGKLLPYEPENYPYQLGEISSLPCPGGRLGGGGGRMTPF

SEQ ID NO: 65699 - protein, 501 aa, Homo sapiens
METNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPTWWPLPTQVPAAEDYLTWKEWGFTGVQEVLSALLRATPGEYSVNICGMNEHPVCSRTWTNRLCHQEMGSKKTVTQEDRGW

SEQ ID NO: 65700 - protein, 385 aa, Homo sapiens
MGRWCQTVARGQRPRTSAPSRAGALLLLLLLLRSAGCWGAGEAPGALSTADPADQSVQCVPKATCPSSRPRLLWQTPTTQTLPSTTMETQFPVSEGKVDPYRSCGFSYEQDPTLRDPEAVARRWPWMVSVRANGTHICAGTIIASQWVLTVAHCLIWRDVIYSVRVGSPWIDQMTQTASDVPVLQVIMHSRYRAQRFWSWVGQANDIGLLKLKQELKYSNYVRPICLPGTDYVLKDHSRCTVTGWGLSKADGMWPQFRTIQEKEVIILNNKECDNFYHNFTKIPTLVQIIKSQMMCAEDTHREKFCYELTGEPLVCSMEGTWYLVGLVSWGAGCQKSEAPPIYLQVSSYQHWIWDCLNGQALALPAPSRTLLLALPLPLSLLAAL

SEQ ID NO: 65701 - protein, 280 aa, Homo sapiens
MATEAPVNIAPPECSTVVSTAVDSLIWQPNSLNMHMIRPKSAKGRTRPSLQKSQGVEVCAHHIPSPPPAIPYELPSSQKPGACAPKSPNQGASDEIPELQQQVPTGASSSLNKYPVLPSINRKNLEEEAVETVAKKASSLQLSSIRALYQDETGTMKTSEEDSRARACAVERKFIVRTKKQGSSRAGNLEEPSDQEPRLLLAVRSPTGQRFVRHFRPTDDLQTIVAVAEQKNKTSYRHCSIETMEVPRRRFSDLTKSLQECRIPHKSVLGISLEDGEGWP

SEQ ID NO: 65702 - protein, 792 aa, Homo sapiens
MQVFQMITKSQRIFSHAQVAAVSSQLPAPEGKPAALRPLQGPWPQQPPPLAPAVDSLHAGPGNPEAEGSPARRRKTTPGVPREASPGSTRRDAKGGLKVAAVPTPLAAPSLDPSRNPDISSLAKQLRSSKGTLDLEDIFPSTGQRQTQLGGEEPPGASLPGKQAPAENGAASRITKGEKGPACSRGGGYRLLGNPRAPRFSGFRKEKAKMDMCCAASPSQVAMASFSSAGPPADPSKSKLTIFSRIQGGNIYRLPHPVKEENVAGRGNQQNGSPTDWTKPRSTFVCKNCSQMFYTEKGLSSHMCFHSDQWPSPRGKQEPQVFGTEFCKPLRQVLRPEGDRHSPPGTKKPLDPTAAAPLVVPQSIPVVPVTRHIGSMAMGQEKDGEERDSKESSQQRKRKKRPPPSTAGEPGPAGCHQSRLRSPMFLVDCLLKGLFQCSPYTPPPMLSPIREGSGVYFNTLCSTSTQASPDQLISSMLDQVDGSFGICVVKDDTKISIEPHINIGSRFQAEIPELQERSLAGTDEHVASLVWKPWGDMMISSETQDRVTELCNVACSSVMPGGGTNLELALHCLHEAQGNVQVALETLLLRGPHKPRTHLLADYRYTGSDVWTPIEKRLFKKAFYAHKKDFYLIHKMIQTKTVAQCVEYYYIWKKMIKFDCGRAPGLEKRVKREPEEVERTEEKVPCSPRERPSHHPTPKLKTKSYRRESILSSSPNAGSKRTPELLGSAESQGIFPCRECERVFDKIKSRNAHMKRHRLQDHVEPIIRVKWPVKPFQLKEEELGADIGPLQW

SEQ ID NO: 65703 - DNA, 20 bp, Homo sapiens
gatcgttaaatacagaaggc

SEQ ID NO: 65704 - DNA, 20 bp, Homo sapiens
gatcgtattcgtagcggcgg

SEQ ID NO: 65705 - DNA, 20 bp, Homo sapiens
gatctttggagcgtttgtct

SEQ ID NO: 65706 - DNA, 20 bp, Homo sapiens
gatcattctggatgtcacca

SEQ ID NO: 65707 - DNA, 20 bp, Homo sapiens
gatcccttcctccctccgac

SEQ ID NO: 65708 - DNA, 20 bp, Homo sapiens
gatctagaattggaaaaatt

SEQ ID NO: 65709 - DNA, 20 bp, Homo sapiens
gatcttcattacagcaaggc

SEQ ID NO: 65710 - DNA, 20 bp, Homo sapiens
gatcctgcgactgcgagtgg

SEQ ID NO: 65711 - DNA, 20 bp, Homo sapiens
gatcacaggaaaacctgctc

SEQ ID NO: 65712 - DNA, 20 bp, Homo sapiens
gatctccgtgaaattaaaaa

SEQ ID NO: 65713 - DNA, 20 bp, Homo sapiens
gatcactggaatggaattcc

SEQ ID NO: 65714 - DNA, 20 bp, Homo sapiens
gatcgtgggtcacaggcccg

SEQ ID NO: 65715 - DNA, 20 bp, Homo sapiens
gatcagtgtttccagatgat

SEQ ID NO: 65716 - DNA, 20 bp, Homo sapiens
gatcattgcttgaatctact

SEQ ID NO: 65717 - DNA, 20 bp, Homo sapiens
gatcatttttataaccatgg

SEQ ID NO: 65718 - DNA, 20 bp, Homo sapiens
gatcttttgttaaatgaaac

SEQ ID NO: 65719 - DNA, 20 bp, Homo sapiens
gatcgccgcatggaaaacct

SEQ ID NO: 65720 - DNA, 20 bp, Homo sapiens
gatctttcaaaaactataat

SEQ ID NO: 65721 - DNA, 20 bp, Homo sapiens
gatcatgatggaaaagacaa

SEQ ID NO: 65722 - DNA, 20 bp, Homo sapiens
gatcactttttgttcaaaag

SEQ ID NO: 65723 - DNA, 20 bp, Homo sapiens
gatcttacaaacctgcaaat

SEQ ID NO: 65724 - DNA, 20 bp, Homo sapiens
gatcatcaacagtatttcga

SEQ ID NO: 65725 - DNA, 20 bp, Homo sapiens
gatccaaatgaattcaatga

SEQ ID NO: 65726 - DNA, 20 bp, Homo sapiens
gatcttctgttattaaaaca

SEQ ID NO: 65727 - DNA, 20 bp, Homo sapiens
gatcagcagcatcatccagg

SEQ ID NO: 65728 - DNA, 20 bp, Homo sapiens
gatccttggaattatcctag

SEQ ID NO: 65729 - DNA, 20 bp, Homo sapiens
gatccagccctaacacgcct

SEQ ID NO: 65730 - DNA, 20 bp, Homo sapiens
gatcccactttgaaatacat

SEQ ID NO: 65731 - DNA, 20 bp, Homo sapiens
gatcacacttgtaaagtttg

SEQ ID NO: 65732 - DNA, 20 bp, Homo sapiens
gatctgaaacccgacacgca

SEQ ID NO: 65733 - DNA, 20 bp, Homo sapiens
gatcagaaccgtatatttga

SEQ ID NO: 65734 - DNA, 20 bp, Homo sapiens
gatcaggaggaggcttgtgc

SEQ ID NO: 65735 - DNA, 20 bp, Homo sapiens
gatcgtgtaccctcccagtt

SEQ ID NO: 65736 - DNA, 20 bp, Homo sapiens
gatcaagcatgagcttccat

SEQ ID NO: 65737 - DNA, 20 bp, Homo sapiens
gatctaaataaagcctctct

SEQ ID NO: 65738 - DNA, 20 bp, Homo sapiens
gatccctctatcccgggtcg

SEQ ID NO: 65739 - DNA, 20 bp, Homo sapiens
gatctgagctttcttcttgg

SEQ ID NO: 65740 - DNA, 20 bp, Homo sapiens
gatcatgctcagacatccta

SEQ ID NO: 65741 - DNA, 20 bp, Homo sapiens
gatcatcactaataaacatc

SEQ ID NO: 65742 - DNA, 20 bp, Homo sapiens
gatccgattaagtatagttt

SEQ ID NO: 65743 - DNA, 20 bp, Homo sapiens
gatctccctttaaagtgacc

SEQ ID NO: 65744 - DNA, 20 bp, Homo sapiens
gatcagcactggaaaagccc

SEQ ID NO: 65745 - DNA, 20 bp, Homo sapiens
gatcaaattggatgaaatat

SEQ ID NO: 65746 - DNA, 20 bp, Homo sapiens
gatcaagtcccagagcagga

SEQ ID NO: 65747 - DNA, 20 bp, Homo sapiens
gatccggcctggcacgtgga

SEQ ID NO: 65748 - DNA, 20 bp, Homo sapiens
gatctcaattaaatgtcctc

SEQ ID NO: 65749 - DNA, 20 bp, Homo sapiens
gatctgggcggggtggtgcg

SEQ ID NO: 65750 - DNA, 20 bp, Homo sapiens
gatcgttttccacttaagcg

SEQ ID NO: 65751 - DNA, 20 bp, Homo sapiens
gatcatttgccattactaac

SEQ ID NO: 65752 - DNA, 20 bp, Homo sapiens
gatcctaattacttgcatag

SEQ ID NO: 65753 - DNA, 20 bp, Homo sapiens
gatccttcctggaagaaggc

SEQ ID NO: 65754 - DNA, 20 bp, Homo sapiens
gatcctcgtccctcccaaga

SEQ ID NO: 65755 - DNA, 20 bp, Homo sapiens
gatcactactccaatggagt

SEQ ID NO: 65756 - DNA, 20 bp, Homo sapiens
gatccgcagctcgaaaaaga

SEQ ID NO: 65757 - DNA, 20 bp, Homo sapiens
gatcctggctgggaagttag

SEQ ID NO: 65758 - DNA, 20 bp, Homo sapiens
gatcagacatcagcaccttc

SEQ ID NO: 65759 - DNA, 20 bp, Homo sapiens
gatcatcttacgatatcaag

SEQ ID NO: 65760 - DNA, 20 bp, Homo sapiens
gatcataaagaccgtgtcct

SEQ ID NO: 65761 - DNA, 20 bp, Homo sapiens
gatcttcataccacagttgt

SEQ ID NO: 65762 - DNA, 20 bp, Homo sapiens
gatcatctgctacaacccaa

SEQ ID NO: 65763 - DNA, 20 bp, Homo sapiens
gatctgtaaagaggtgcagg

SEQ ID NO: 65764 - DNA, 20 bp, Homo sapiens
gatcctgccgtgagttaaga

SEQ ID NO: 65765 - DNA, 20 bp, Homo sapiens
gatctgggactgcctcaacg

SEQ ID NO: 65766 - DNA, 20 bp, Homo sapiens
gatcatgacttctcctttcc

SEQ ID NO: 65767 - DNA, 20 bp, Homo sapiens
gatctacttggcaggaataa

SEQ ID NO: 65768 - DNA, 20 bp, Homo sapiens
gatcactctttttatctgag

SEQ ID NO: 65769 - DNA, 20 bp, Homo sapiens
gatctccaacacgctgggcc

SEQ ID NO: 65770 - DNA, 20 bp, Homo sapiens
gatctaaaacaaagttctgt

SEQ ID NO: 65771 - DNA, 4510 bp, Homo sapiens
gggcgctgttggcagctggcgacgcggggcgaagccgcggctggcggcgcctggccagtcccgcatccgccgcggtgggtgtgcccgcaggggtgcgccggggccagggccgagaccgtcggccagagggcgcctggagggtgtgcgcgccgcggacgaccagggtgcgccagccccggggtgcgcgcctgggacgcggacagtgcacccggaggttgcgtgcgctccgaagccggggtgtgcgcctagctgccccggccccgtgcaccgcgggccgcctcgcgcaggacttccgcagctcgccaagaaccttcaacaagttttacagactcattggatgaagagtgcctgagacactgagggtcagcgctccaaagatggagaagacagatgccaaagaccagtcctctcagggggatgaagagaaagaccctccgaagagccacccttattctgtggagaccccatatggctttcatttagacctggacttcctcaagtatgtggatgacatcgagaagggaaacactatcaaaagaattcctatccacagaagggccaagcaggccaaatttagcactctgccccgaaacttcagccttcctgacagtggggctcgcccccctgcagccccgcccctccaaaactggtctcccgtggtgccaagggaggcatcacttgggacacaggagcaaaaccagtcgccgccgcttggtaatgccccccaggcctcaacaagcaggagtgaggtgagctaccacaggaaggctctgttggcagaggccaccagacagttggaagctgctgagccagaggatgccgagctcacttttgggagtggacggccccagctcttgagagcatccagcatgcctgccacgctgctgcacagcagggcttctgaggagccaggcctgagcctggggccccctgcccctcctgccctccctccccttcagggtgaaggcagtgtctgtgatggcacctttgaacctgcagaaggattggcaggtttccacagctccagcccacgagcatcaactcggattccagagctggtccaggagggagctgagcctccagagggcgtggtgaaggttccaaatcacctccctctcccaggccctcctttctcattccagaatgtgcttgtagttctagaggacaaggaagatgaacacaatgccagagaagcagaggtgttgttcacccctggctcccctacgccaagcccgccacctctgccatcacccatccctgagaatgagctcctcctggaagaaatcgagctcaacatcagcgagattccacccccgccacctgtagaggtggacatgagaagcattggcatcagggtaactgaggaaagcctgggccttgccagggtggatccaggcagcatctccagcctgaaacagcaggtctcggccctggagggagagttgtctggaagaaccgaggaactggcacaggtcagaactgctctccagcagcaggaagaggaaatcaaagctagggagcaaagaattcgagagctggagttcactgtagcccaactggaaggacagtttcaccaagagaacgccaaagacactcagggccagacggacgtgatggtgaacactgaccctgtccatggactcttgaccagggagtcgtgtgataagggcattgaagtcaaccttctaggcagcatggagtctgaaagctgggggcaccgaggagaggagaatggcctcctatgggggccagatggtcataaacaagggaatcagagcccagcagaacgtgtgcttctgccccagctgtcactgccacagggacccgagcaggtccttacctcctctgtacatagcttcctctccactgaactcaggattgaagaagcaggcactgaacaggaaggaggccctcagggaggaaccaggggagcaggaggctttctgtggggcagtgacagaaagactcccccagcagggagggaggagaccagttccaatctcccagggaaggagcacccgggaaggccaccaagctcgccaacggatgccactattgggcagtatgtgaagaagatccaggagctcctgcaggagcagtggaactgcctggagcatgggtacccggagctggccagcgccatcaagcagccagcctccaagctcagcagcatccagagccagctgctgagctccctcaacctgctgctgtcggcctactcggcccaggctcacccacccaaggagccgccggcctcctcctcctccccgccagtggagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccaccacagaccagctcttgaggcaaagcttgaacaccatcagtcaagagtggttccgcgtctccagccggaagtcgtctagccctgccgtggtggcctcctacctccacgaggtccagcctcactccccacacttcctgaagctgcttgtcaacttggccgatcgcaacgggaacacggcccttcactacagcgtgtcccactccaacttctccatcgcgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatgctggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaataaagaaaaaaaagaaattcaatccaatgacacacaccacatgtatttgggcagagtcagattctctcagctattttgagtctgtggaagaaacaaaaaaaagcttcctcctgaggatgggttattgtcatcaagaagccacctgcatagccgtatccattacctcatggtaattcccggtgctttcccctcatatcccctagaagcaaatatctgttctgaggttttttgggacttctggctgcaataggagcaagggacccaggcagggcagagcaataccttccgaagcttccatattccctggggccagcacatgcaaggtttatatggtcagtagctcacgtgaagtcatctgaatctttcttaaatctgctctcttaaaatctcttatgccaaaaaaaaaaaaaaaa

SEQ ID NO: 65772 - protein, 995 aa, Homo sapiens
MEKTDAKDQSSQGDEEKDPPKSHPYSVETPYGFHLDLDFLKYVDDIEKGNTIKRIPIHRRAKQAKFSTLPRNFSLPDSGARPPAAPPLQNWSPVVPREASLGTQEQNQSPPLGNAPQASTSRSEVSYHRKALLAEATRQLEAAEPEDAELTFGSGRPQLLRASSMPATLLHSRASEEPGLSLGPPAPPALPPLQGEGSVCDGTFEPAEGLAGFHSSSPRASTRIPELVQEGAEPPEGVVKVPNHLPLPGPPFSFQNVLVVLEDKEDEHNAREAEVLFTPGSPTPSPPPLPSPIPENELLLEEIELNISEIPPPPPVEVDMRSIGIRVTEESLGLARVDPGSISSLKQQVSALEGELSGRTEELAQVRTALQQQEEEIKAREQRIRELEFTVAQLEGQFHQENAKDTQGQTDVMVNTDPVHGLLTRESCDKGIEVNLLGSMESESWGHRGEENGLLWGPDGHKQGNQSPAERVLLPQLSLPQGPEQVLTSSVHSFLSTELRIEEAGTEQEGGPQGGTRGAGGFLWGSDRKTPPAGREETSSNLPGKEHPGRPPSSPTDATIGQYVKKIQELLQEQWNCLEHGYPELASAIKQPASKLSSIQSQLLSSLNLLLSAYSAQAHPPKEPPASSSSPPVEISPSTSLKSIMKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAERYKPSEEFLNACRALSQHLPETGTTTDQLLRQSLNTISQEWFRVSSRKSSSPAVVASYLHEVQPHSPHFLKLLVNLADRNGNTALHYSVSHSNFSIAKLLLETGVCNVDHQNKAGYTAVMITPLASAETNEDMAVVWKLLREGNVNIQATQGGQTALMLGVSHDREDMVQALLSCQADVNLQDHDGSSALMLACHHGNVDLVRLLLAHPACDSSLTDKAGRTALSIALKSPTHMEIAGLLRAHAEQGRSLGL

SEQ ID NO: 65773 - DNA, 20 bp, Homo sapiens
gatcctcggccctcatgctg

SEQ ID NO: 65774 - DNA, 20 bp, Homo sapiens
gatcaaactcatagaaactg

SEQ ID NO: 65775 - DNA, 20 bp, Homo sapiens
gatcttgtaatagaaacatc

SEQ ID NO: 65776 - DNA, 20 bp, Homo sapiens
gatcgcttgaaaccaggagt

SEQ ID NO: 65777 - DNA, 5233 bp, Homo sapiens
accccgagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatggttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgccaccctcgcgtagctttcctgtggttttccaggactgtccggtacagcccgggctccgcgtgccccgcccgctggagcacctgccaccgaggcgcgcgtggggccactgccgtggcggcggctgccctcctcacactcggctccgcgccgcctccggccaccgtgcgctcccgcgtggggcgcctcggatgggcccgggagggctgggggctcttccctggaggaagcggcctccgcttcgctggcgccgcctttttagcttggacttcagtcctccctcggggactcacctccggagtaaacggctcttcattagcttggagtggccgcaggtcccgtgaccagcacccgcgagaccctgtgcgacagctgggctgatgctccgtttctctgggaattggtgattttttactgtgaagatgaaattaccctaatagcatgaagatcgtgggtctgtgtgtccgtgaagtgagtcccgtctgccaggagctgacgaaccacgaatgcttctgcctgtgctgtgcattcccaggcccgcagctcccggtcgaggggactccgatgtgaatttgttgtgaatttgttgtgccacaatagcagttctggaatgaagctaggaaactcgagtgtgctttttgtttaatgagcgttcaccaagctgagccggagccatcctttcggtggtagttggggaaggctatgcagatttgctctgttgtgacgcgttggtgacggtgcccagcctgcggttccccacagcatcgcaggcgctcggaaatcctctcccgtgcctttagaggaaggagaggattgctgaggaatgcagggacgcctgtttctgtcctcacaccacagaaagaaacctgagggaaaactgagacgtgaggttcctgatttaagaagcctgggtttcttcatggtggggggccatttggaatgacagcctcacttccttctgatggctacatctgtatcttttcctcctgtgtttaatgtttcactagggagaggaaataaagcagaaggaacgtgtgaagctctgtgtctcagacggggccctcccgtcgagaagctggtagtcagtgagtgagaacaagagaacaagaacaccctgaacagtcctggttgggatggtgtccacattcatgttctgcggttcttgaacacacggatgcctctgggccacctgtccttttccgagggtgtgggtgggagtggatcctccgggcgcaggtgccaggcaggtgcaggcgggcggtcggccactgctgctgctcgtccctgccagtgtctgggcctgaaggggctccctccaagcggtgccttcctgcggcttagaagggaaagcgccagagagggcaggctacagtgcttcacacccttcgccacggctgtgaaactggagatgggtgggttttgtatgttaatttttttttttgagacggagtcttgctctgtcacccaggctggagagcagtggcgtgatctcggctcactgcaagctccgcctcccgggttcacgccattctcctgcctcagcccccccgagtagctgggactacaggcgcccgccaccacgcctggctaattttttatatttttagtagagacagggtttcaccatgttaaccaggatggtctcgatctcctgacctcacgatttgcccgcctcggcttcccagagtgctgggattacaggcgtgagccaccgcgcctggccacccagctaagtttgtatttttgttggagacggggtttcaccatattggccagactggtctcaaactcctggggtcaaatgatccgcctgcgtcggcttcccagagtgctgggattacaggtgtcagccactgcgctcagctgggagatgaattttcatttaatgacttaactttttgttagcacaggttttgtgtgtgtgtgtgtgtgtgtgttttgttttttgttttgtgtttttgaaacggagttttgctctgtcacccaggctggaatgcaatggcaccatcttggctcactgcaacctctgcttcctgggttcaagtgattctcttgccttagcctcccgagcagctgggattataggcgtccaccaccacgcccagctaatttttgtatttttagtagaaatggggtttcaccatgtgtggccaggctggtctcgaactcctgacctgaagtgatccacccgcctcgacctcccaaagtgctgggatgacaggcatgagccaccgcacccggccaacacagatgtttattgatcgtggaggatacattgtggaaaatgtttttctctcttttaccatttttgggaagagggataggtaagtgcagggagtttgtgctgaaacagcgcctggcaatttttcagaaatgaatttgatattgcgctccacctttgagctgttcacacctgtggctacccctggaaagcgctggggttgttgatgcttttggctgcccggcttcctgaggtctcgctgctttttggggaaagatgactggcttccctgtgggacgcttttgtctgacacgtgatgatgtggtcctgcctgccactgtgcaccatcccaggtattgaattttgaccttttcttttcaagtttctgtgcttagtgtttttaatgtttacttttgccacttacaataatatcaccaaaataatatgcatagagttttggaagaaacatagaaaacatgagcagaatgagacaattccttgggctgtagtttggacccaactgaatcctgagtgctctgtggctgacgctgtctacccgtgggagagacacactcaggagtggccgtttggccagaaaagaaggtcatggcccctggcctggcccccgccctgcagggacacagaagccacaccatttgcaccatccacgccttgctccagaaggcctggccgccttctccctgggggtgattcaaggatttggtctcggaccagacccccctccacagctgcccggccccagacccatctcttggattgagggtgtgtgggctggaaccagtgggtcactgtggcagcttcatctgagccgaaggtgtgggtcctctgtggctgtgcgattgacctcgatgggaaggagcgttctacccattttccttgttttcagtgctgcggtatcagtcagtgatctgaggaaatcctgtaggggaaggcaggctgcagtgaaaacaggagctggtgaaaccgagccctctgcatctgcgaatgtgccctaggtgctgctgctggggacatggatgccaagcggaggcctgcgtggcctcctgagcagcagctgaccgcccgtctcatgctggacgggacccctgggcgggtggacatgagaccactgttggccagggacgccgtgcggaggcctacgtggctgcctgagcagcagctgaccgcccgtctcactgttggccagggctttgtggcgtgggtgttttccagtctgcctggagcagcgagaagcagctgtgcagactggtggcggtgggagggtttgctgggactgatggggacaccggccagcttgtctggtgtccagcagccctgccggacttggcctcctgtcctgtcgttgggagccctggctggggctgctttgagcaatgacgctggcccagagcagcttcccacatgaccccagagccgagggtctgccctgtcctaggttaggtcttcatggtttagagtaaaaccgtgagggatgttaattatgggcattgaagacttaaggttttcttaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaacaaacaaaaaaaaaaaaaaaaaaaaaaaaaaaaaaaaaaaaa

SEQ ID NO: 65778 - DNA, 5186 bp, Homo sapiens
agcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatggttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgccaccctcgcgtagctttcctgtggttttccaggactgtccggtacagcccgggctccgcgtgccccgcccgctggagcacctgccaccgaggcgcgcgtggggccactgccgtggcggcggctgccctcctcacactcggctccgcgccgcctccggccaccgtgcgctcccgcgtggggcgcctcggacgggcccgggagggctgggggctcttccctggaggaagcggcctccgcttcgctggcgccgcctttttagcttggacttcagtcctccctcggggactcacctccggagtaaacggctcttcattagcttggagtggccgcaggtcccgtgaccagcacccgcgagaccctgtgcgacagctgggctgatgctccgtttctctgggaattggtgattttttactgtgaagatgaaattaccctaatagcatgaagatcgtgggtctgtgtgtccgtgaagtgagtcccgtctgccaggagctgacgaaccacgaatgcttctgcctgtgctgtgcattcccgggcccgcagctcccggtcgaggggactccgatgtgaatttgttgtgaatttgttgtgccacaatagcagttctggaatgaagctaggaaactcgagtgtgctttttgtttaatgagcgttcaccaagctgagccggagccatcctttcggtggtagttggggaaggctatgcagatttgctctgttgtgacgcgttggtgacggtgcccagcctgcggttccccacagcatcgcaggcgctcggaaatcctctcccgtgcctttagaggaaggagaggattcctgaggaatgcagggacgcctgtttctgtcctcacaccacagaaagaaacctgagggaaaactgagacgtgaggttcctgatttaagaagcctgggtttcttcatggtggggggccatttggaatgacagcctcacttccttctgatggctacatctgtatcttttcctcctgtgtttaatgtttcactagggagaggaaataaagcagaaggaacgtgtgaagctctgtgtctcagacggggctctcccgtcgagaagctggtagtcagtgagtgagaacaagagaacaagaacaccctgaacagtcctggttgggatggtgtccacattcatgttctgcggttcttgaacacacggatgcctctgggccacctgtccttttccgagggtgtgggtgggagtggatcctccgggcgcaggtgccaggcaggtgcaggcgggcggtcggccactgctgctgctcgtccctgccagtgtctgggcctgaaggggctccctccaagcggtgccttcctgcggcttagaagggaaagcgccagagagggcaggctacagtgcttcacaccctccgccacggctgtgaaactggaaatgggtgggttttgtatgttaatttttttttttgagacggagtcttgctctgtcacccaggctggagagcagtggcgtgatctcggctcactgcaagctccgcctcccgggttcacgccattctcctgcctcagcccccccgagtagctgggactacaggcgcccgccaccacgcctggctaattttttatatttttagtagagacagggtttcaccatgttaaccaggatggtctcgatctcctgacctcacgatttgcccgcctcggcttcccagagtgctgggattacaggcgtgagccaccgcgcctggccacccagctaagtttgtatttttgttggagacggggtttcaccatattggccagactggtctcaaactcctggggtcaaatgatccgcctgcgtcggcttcccagagtgctgggattacaggtgtcagccactgcgctcagctgggagatgaattttcatttaatgacttaactttttgttagcacaggttttgtgtgtgtgtgtgtgtgtgtgttttgttttttgttttgtgtttttgaaacggagttttgctctgtcacccaggctggaatgcaatggcaccatcttggctcactgcaacctctgcttcctgggttcaagtgattctcttgccttagcctcccgagcagctgggattataggcgtccaccaccacgcccagctaatttttgtatttttagtagaaatggggtttcaccatgtgtggccaggctggtctcgaactcctgacctgaagtgatccacccgcctcgacctcccaaagtgctgggatgacaggcatgagccaccgcacccggccaacacagatgtttattgatcgtggaggataaattgtggaaaatgtttttctctcttttaccatttttgggaagagggataggtaagtgcagggagtttgtgctgaaacagcgcctggcaatttttcagaaatgaatttgatattgcgctccacctttgagctgttcacacctgtggctacccctggaaagcgctggggttgttgatgcttttggctgcccggcttcctgaggtctcgctgctttttggggaaagatgactggcttccctgtgggacgcttttgtctgacacgtgatgatgtggtcctgcctgccactgtgcaccatcccaggtattgaattttgaccttttcttttcaagtttctgtgcttagtgtttttaatgtttacttttgccacttacaataatatcaccaaaataatatgcatagagttttggaagaaacatagaaaacatgagcagaatgagacaattccttgggctgtagtttggacccaactgaatcctgagtgctctgtggctgacgctgtctacccgtgggagagacacactcaggagtggccgtttggccagaaaagaaggtcatggcccctggcctggcccccgccctgcagggacacagaagccacaccatttgcaccatccacgccttgctccagaaggcctggccgccttctccctgggggtgattcaaggatttggtctcggaccagacccccctccacagctgcccggccccagacccatctcttggattgagggtgtgtgggctggaaccagtgggtcactgtggcagcttcatctgagccgaaggtgtgggtcctctgtggctgtgcgattgacctcgatgggaaggagcgttcggcccattttccttgttttcagtgctgcggtatcagtcagtgatctgaggaaatcctgtaggggaaggcaggctgcagtgaaaacaggagctggtgaaaccgagccctctgcatctgcgaatgtgccctaggtgctgctgctggggacatggatgccgagcggaggcctgcgtggcctcctgagcagcagctgactacccgtctcatgctggacgggacccctgggcgggtggacatgagaccactgttggccagggacgccgtgcggaggcctacgtggctgcctgagcagcagctgaccgcccgtctcactgttggccagggctttgtggcgtgggtgttttccagtctgcctggagcagcgagaagcagctgtgcagactggtggcggtgggagggtttgctgggactgatggggacaccggccagcttgtctggtgtccagcagccctgccggacttggcctcctgtcctgtcgttgggagccctggctggggctgctttgagcaatgacgctggcccagagcagcttcccacatgaccccagagccgagggtctgccctgtcctaggttaggtcttcatggtttagagtaaaaccgtgagggatgttaattatgggcattgaagacttaaggttttcctaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaac

SEQ ID NO: 65779 - DNA, 3673 bp, Homo sapiens
agcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatggttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgccaccctcgcgtagctttcctgtggttttccaggactgtccggtacagcccgggctccgcgtgccccgcccgctggagcacctgccaccgaggcgcgcgtggggccactgccgtggcggcggctgccctcctcacactcggctccgcgccgcctccggccaccgtgcgctcccgcgtggggcgcctcggacgggcccgggagggctgggggctcttccctggaggaagcggcctccgcttcgctggcgccgcctttttagcttggacttcagtcctccctcggggactcacctccggagtaaacggctcttcattagcttggagtggccgcaggtcccgtgaccagcacccgcgagaccctgtgcgacagctgggctgatgctccgtttctctgggaattggtgattttttactgtgaagatgaaattaccctaatagcatgaagatcgtgggtctgtgtgtccgtgaagtgagtcccgtctgccaggagctgacgaaccacgaatgcttctgcctgtgctgtgcattcccgggcccgcagctcccggtcgaggggactccgatgtgaatttgttgtgaatttgttgtgccacaatagcagttctggaatgaagctaggaaactcgagtgtgctttttgtttaatgagcgttcaccaagctgagccggagccatcctttcggtggtagttggggaaggctatgcagatttgctctgttgtgacgcgttggtgacggtgcccagcctgcggttccccacagcatcgcaggcgctcggaaatcctctcccgtgcctttagaggaaggagaggattcctgaggaatgcagggacgcctgtttctgtcctcacaccacagaaagaaacctgagggaaaactgagacgtgaggttcctgatttaagaagcctgggtttcttcatggtggggggccatttggaatgacagcctcacttccttctgatggctacatctgtatcttttcctcctgtgtttaatgtttcactagggagaggaaataaagcagaaggaacgtgtgaagctctgtgtctcagacggggctctcccgtcgagaagctggtagtcagtgagtgagaacaagagaacaagaacaccctgaacagtcctggttgggatggtgtccacattcatgttctgcggttcttgaacacacggatgcctctgggccacctgtccttttccgagggtgtgggtgggagtggatcctccgggcgcaggtgccaggcaggtgcaggcgggcggtcggccactgctgctgctcgtccctgccagtgtctgggcctgaaggggctccctccaagcggtgccttcctgcggcttagaagggaaagcgccagagagggcaggctacagtgcttcacaccctccgccacggctgtgaaactggaaatggaaatgaatttgatattgcgctccacctttgagctgttcacacctgtggctacccctggaaagcgctggggttgttgatgcttttggctgcccggcttcctgaggtctcgctgctttttggggaaagatgactggcttccctgtgggacgcttttgtctgacacgtgatgatgtggtcctgcctgccactgtgcaccatcccagtgctgcggtatcagtcagtgatctgaggaaatcctgtaggggaaggcaggctgcagtgaaaacaggagctggtgaaaccgagccctctgcatctgcgaatgtgccctaggtgctgctgctggggacatggatgccgagcggaggcctgcgtggcctcctgagcagcagctgactacccgtctcatgctggacgggacccctgggcgggtggacatgagaccactgttggccagggacgccgtgcggaggcctacgtggctgcctgagcagcagctgaccgcccgtctcactgttggccagggctttgtggcgtgggtgttttccagtctgcctggagcagcgagaagcagctgtgcagactggtggcggtgggagggtttgctgggactgatggggacaccggccagcttgtctggtgtccagcagccctgccggacttggcctcctgtcctgtcgttgggagccctggctggggctgctttgagcaatgacgctggcccagagcagcttcccacatgaccccagagccgagggtctgccctgtcctaggttaggtcttcatggtttagagtaaaaccgtgagggatgttaattatgggcattgaagacttaaggttttcctaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaac

SEQ ID NO: 65780 - DNA, 1933 bp, Homo sapiens
gacctgaagtgatccacccgcctcgacctcccaaagtgctgggatgacaggcatgagccaccgcacccggccaacacagatgtttattgatcgtggaggatacattgtggaaaatgtttttctctcttttaccatttttgggaagagggataggtaagtgcagggagtttgtgctgaaacagcgcctggcaatttttcagaaatgaatttgatattgcgctccacctttgagctgttcacacctgtggctacccctggaaagcgctggggttgttgatgcttttggctgcccggcttcctgaggtctcgctgctttttggggaaagatgactggcttccctgtgggacgcttttgtctgacacgtgatgatgtggtcctgcctgccactgtgcaccatcccaggtattgaattttgaccttttcttttcaagtttctgtgcttagtgtttttaatgtttacttttgccacttacaataatatcaccaaaataatatgcatagagttttggaagaaacatagaaaacatgagcagaatgagacaattccttgggctgtagtttggacccaactgaatcctgagtgctctgtggctgacgctgtctacccgtgggagagacacactcaggagtggccgtttggccagaaaagaaggtcatggcccctggcctggcccccgccctgcagggacacagaagccacaccatttgcaccatccacgccttgctccagaaggcctggccgccttctccctgggggtgattcaaggatttggtctcggaccagacccccctccacagctgcccggccccagacccatctcttggattgagggtgtgtgggctggaaccagtgggtcactgtggcagcttcatctgagccgaaggtgtgggtcctctgtggctgtgcgattgacctcgatgggaaggagcgttctacccattttccttgttttcagtgctgcggtatcagtcagtgatctgaggaaatcctgtaggggaaggcaggctgcagtgaaaacaggagctggtgaaaccgagccctctgcatctgcgaatgtgccctaggtgctgctgctggggacatggatgccaagcggaggcctgcgtggcctcctgagcagcagctgaccgcccgtctcatgctggacgggacccctgggcgggtggacatgagaccactgttggccagggacgccgtgcggaggcctacgtggctgcctgagcagcagctgaccgcccgtctcactgttggccagggctttgtggcgtgggtgttttccagtctgcctggagcagcgagaagcagctgtgcagactggtggcggtgggagggtttgctgggactgatggggacaccggccagcttgtctggtgtccagcagccctgccggacttggcctcctgtcctgtcgttgggagccctggctggggctgctttgagcaatgacgctggcccagagcagcttcccacatgaccccagagccgagggtctgccctgtcctaggttaggtcttcatggtttagagtaaaaccgtgagggatgttaattatgggcattgaagacttaaggttttcttaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaac

SEQ ID NO: 65781 - DNA, 1933 bp, Homo sapiens
gacctgaagtgatccacccgcctcgacctcccaaagtgctgggatgacaggcatgagccaccgcacccggccaacacagatgtttattgatcgtggaggataaattgtggaaaatgtttttctctcttttaccatttttgggaagagggataggtaagtgcagggagtttgtgctgaaacagcgcctggcaatttttcagaaatgaatttgatattgcgctccacctttgagctgttcacacctgtggctacccctggaaagcgctggggttgttgatgcttttggctgcccggcttcctgaggtctcgctgctttttggggaaagatgactggcttccctgtgggacgcttttgtctgacacgtgatgatgtggtcctgcctgccactgtgcaccatcccaggtattgaattttgaccttttcttttcaagtttctgtgcttagtgtttttaatgtttacttttgccacttacaataatatcaccaaaataatatgcatagagttttggaagaaacatagaaaacatgagcagaatgagacaattccttgggctgtagtttggacccaactgaatcctgagtgctctgtggctgacgctgtctacccgtgggagagacacactcaggagtggccgtttggccagaaaagaaggtcatggcccctggcctggcccccgccctgcagggacacagaagccacaccatttgcaccatccacgccttgctccagaaggcctggccgccttctccctgggggtgattcaaggatttggtctcggaccagacccccctccacagctgcccggccccagacccatctcttggattgagggtgtgtgggctggaaccagtgggtcactgtggcagcttcatctgagccgaaggtgtgggtcctctgtggctgtgcgattgacctcgatgggaaggagcgttcggcccattttccttgttttcagtgctgcggtatcagtcagtgatctgaggaaatcctgtaggggaaggcaggctgcagtgaaaacaggagctggtgaaaccgagccctctgcatctgcgaatgtgccctaggtgctgctgctggggacatggatgccgagcggaggcctgcgtggcctcctgagcagcagctgactacccgtctcatgctggacgggacccctgggcgggtggacatgagaccactgttggccagggacgccgtgcggaggcctacgtggctgcctgagcagcagctgaccgcccgtctcactgttggccagggctttgtggcgtgggtgttttccagtctgcctggagcagcgagaagcagctgtgcagactggtggcggtgggagggtttgctgggactgatggggacaccggccagcttgtctggtgtccagcagccctgccggacttggcctcctgtcctgtcgttgggagccctggctggggctgctttgagcaatgacgctggcccagagcagcttcccacatgaccccagagccgagggtctgccctgtcctaggttaggtcttcatggtttagagtaaaaccgtgagggatgttaattatgggcattgaagacttaaggttttcctaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaac

SEQ ID NO: 65782 - DNA, 1933 bp, Homo sapiens; identical to SEQ ID NO: 65781

SEQ ID NO: 65783 - DNA, 4161 bp, Homo sapiens
gcgcgcgggcggcgtagccggcctgtctgggccgcctcgtggggagggagggggcgcccggccgcccggcggcgaccccggggcctggccgccaccatgggcttcgagctggaccgcttcgacggcgacgtggacccggacctgaagtgcgcgctgtgccacaaggtcctggaggacccgctgaccacgccgtgcggccacgtcttctgcgccggctgcgtgctgccctgggtggtgcaggagggcagctgcccggcgcgctgccgcggtcgcctgtcggccaaagagctcaaccacgtcctgccgctcaagcgccttatcctcaagctggacatcaagtgcgcgtacgcgacgcgcggctgcggccgggtggtcaagctgcagcagctgccggagcacctcgagcgctgcgacttcgcgcccgcgcgctgtcgccacgcgggttgcggccaggtgctgctgcggcgcgacgtggaggcgcacatgcgcgacgcgtgcgacgcgcggccagtgggccgctgccaggagggctgcgggctacccttgacgcacggcgagcagcgcgcgggcggccactgctgcgcgcgagcgctgcgggcgcacaacggcgcgctccaggcccgcctgggcgcgctgcacaaggcgctcaagaaggaggcgctgcgcgctgggaagcgcgagaagtcgctggtggcccagctggccgcggcgcagcttgagctgcagatgaccgcgctgcgctaccagaagaaattcaccgaatacagcgcgcgcctcgactcgctcagccgctgcgtggccgcgccgcccggcggcaagggcgaagaaaccaaaagtctgactcttgtcctgcatcgggactccggctccctgggattcaatattattggtggccggccgagtgtggataaccacgatggatcatccagtgaaggaatctttgtatccaagatagttgacagtgggcctgcagccaaggaaggaggcctgcaaattcatgacaggattattgaggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctgtggggaccacggaagcctacgggccagcctccaagaatctgctctccatcacggaagatcccgaagtgggcacccctacctatagcccgtccctgaaggagctggaccccaaccagcccctggaaagcaaagagcggagagccagcgacgggagccggagccccacgcccagccagaagctgggcagcgcctacctgccctcctatcaccactccccatacaagcacgcgcacatcccggcgcacgcccagcactaccagagctacatgcagctgatccagcagaagtcggccgtggagtacgcgcaaagccagatgagcctggtgagcatgtgcaaggacctgagctctcccaccccgtcggagccgcgcatggagtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttcaaatagcaattgtacttttctacctgtacccttttacataaagtgtttaaatttcagaaagatcttttattaagcatactttcacagaataacttgtttaaactatattcatataaaaaagttaaacacgctttttttcctgcctaaaacacaaatacaactgccagtatgtatttttaatggaaccctattttataatggtacgttactgaatgtgtttcatatgcgtgaccgttaagatattatcatttaggtgaaggtttcaactcaaaaccacccaacccggtggttaacgatttaatacatataaccaaaccggcagcgtttagagttgggatatacatttaaacattttcctggttaaggttcccaagagagtgtaaaggttttagcagaaagcaaaatatcttgcatctttatggaagtttaaagcatgtttgcaaatattgcagcccattgaaagaatttgcatgtacaggaaagttgtggatggagacggtttgtggaattttaagtgctcattgtagtaaacttttgctttgtagatttgaaggtacagacttatacaggcaagttcacaaaatcatgattagttacaaacagtaaaatgaagttaaaataaattattattttct

SEQ ID NO: 65784 - protein, 240 aa, Homo sapiens
MATAMYLEHYLDSIENLPCELQRNFQLMRELDQRTEDKKAEIDILAAEYISTVKTLSPDQRVERLQKIQNAYSKCKEYSDDKVQLAMQTYEMVDKHIRRLDADLARFEADLKDKMEGSDFESSGGRGLKKGRGQKEKRGSRGRGRRTSEEDTPKKKKHKGGSEFTDTILSVHPSDVLDMPVDPNEPTYCLCHQVSYGEMIGCDNPDCPIEWFHFACVDLTTKPKGKWFCPRCVQEKRKKK

SEQ ID NO: 65785 - protein, 240 aa, Homo sapiens; identical to SEQ ID NO: 65784

SEQ ID NO: 65786 - protein, 240 aa, Homo sapiens; identical to SEQ ID NO: 65784

SEQ ID NO: 65787 - protein, 130 aa, Homo sapiens [sequence omitted]

SEQ ID NO: 65788 - protein, 130 aa, Homo sapiens [sequence omitted]

SEQ ID NO: 65789 - protein, 130 aa, Homo sapiens [sequence omitted]

SEQ ID NO: 65790 - protein, 1066 aa, Homo sapiens
MGFELDRFDGDVDPDLKCALCHKVLEDPLTTPCGHVFCAGCVLPWVVQEGSCPARCRGRLSAKELNHVLPLKRLILKLDIKCAYATRGCGRVVKLQQLPEHLERCDFAPARCRHAGCGQVLLRRDVEAHMRDACDARPVGRCQEGCGLPLTHGEQRAGGHCCARALRAHNGALQARLGALHKALKKEALRAGKREKSLVAQLAAAQLELQMTALRYQKKFTEYSARLDSLSRCVAAPPGGKGEETKSLTLVLHRDSGSLGFNIIGGRPSVDNHDGSSSEGIFVSKIVDSGPAAKEGGLQIHDRIIEVNGRDLSRATHDQAVEAFKTAKEPIVVQVLRRTPRTKMFTPPSESQLVDTGTQTDITFEHIMALTKMSSPSPPVLDPYLLPEEHPSAHEYYDPNDYIGDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPVDECERFRELLELKCQVKSATPYGLYYPSGPLDAGKSDPESVDKELELLNEELRSIELECLSIVRAHKMQQLKEQYRESWMLHNSGFRNYNTSIDVRRHELSDITELPEKSDKDSSSAYNTGESCRSTPLTLEISPDNSLRRAAEGISCPSSEGAVGTTEAYGPASKNLLSITEDPEVGTPTYSPSLKELDPNQPLESKERRASDGSRSPTPSQKLGSAYLPSYHHSPYKHAHIPAHAQHYQSYMQLIQQKSAVEYAQSQMSLVSMCKDLSSPTPSEPRMEWKVKIRSDGTRYITKRPVRDRLLRERALKIREERSGMTTDDDAVSEMKMGRYWSKEERKQHLVKAKEQRRRREFMMQSRLDCLKEQQAADDRKEMNILELSHKKMMKKRNKKIFDNWMTIQELLTHGTKSPDGTRVYNSFLSVTTV

SEQ ID NO: 65791 - DNA, 20 bp, Homo sapiens
gatctgaggaaatcctgtag

SEQ ID NO: 65792 - DNA, 20 bp, Homo sapiens
gatccctatctcttgccaga

SEQ ID NO: 65793 - DNA, 584 bp, Homo sapiens
gcctcctgggatggatgtcacccgcttactcctggccaccctgctggtcttcctctgcttcttcactgccaacagccacctgccacctgaggagaagctccgagatgacaggagcctgagaagcaactcctctgtgaacctactggatgtcccttctgtctctattgtggcgctgaacaagaaatccaaacagatcggcagaaaagcagcagaaaagaaaagatcttctaagaaggaggcttcgatgaagaaagtggtgcggccccggacccccctatctgcgccctgcgtggccacccgcaacagctgcaagccgccggcacccgcctgctgcgacccgtgcgcctcctgccagtgccgcttcttccgcagcgcctgctcctgccgcgtgctcagcctcaactgctgagcgcccccactcccggccgcgagcaggcagggcttcggggacgcggggcgcttctcgggcgggtgatccctaacagggcggcttcccagggctgcaggcgggcggaggttccaggagatgggacttcagggagacctggcttgggctaaaatcgaaatacaatatatataggctg

SEQ ID NO: 65794 - protein, 132 aa, Homo sapiens
MDVTRLLLATLLVFLCFFTANSHLPPEEKLRDDRSLRSNSSVNLLDVPSVSIVALNKKSKQIGRKAAEKKRSSKKEASMKKVVRPRTPLSAPCVATRNSCKPPAPACCDPCASCQCRFFRSACSCRVLSLNC

SEQ ID NO: 65795 - DNA, 20 bp, Homo sapiens
gatccctaacagggcggctt

SEQ ID NO: 65796 - DNA, 20 bp, Homo sapiens
gatcccggagcagctcagag

SEQ ID NO: 65797 - DNA, 2471 bp, Homo sapiens
agaaagcgagcagccacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcagggaaaaaaaaaaaaaaaaaaaa

SEQ ID NO: 65798 - DNA, 1824 bp, Homo sapiens
ggagaataaaataatcaggaggctgggtttgtgcttggctccaagcatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagttctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctaaaaaaaaaaaaaaaaaaaaaa

SEQ ID NO: 65799 - protein, 757 aa, Homo sapiens
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 65800 - protein, 444 aa, Homo sapiens
MPRSGAPKERPAEPLTPPPSYGHQPQTGSGESSGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQVVTALGRAWHPEHFVCGGCSTALGGSSFFEKDGAPFCPECYFERFSPRCGFCNQPIRHKMVTALGTHWHPEHFCCVSCGEPFGDEGFHEREGRPYCRRDFLQLFAPRCQGCQGPILDNYISALSALWHPDCFVCRECFAPFSGGSFFEHEGRPLCENHFHARRGSLCATCGLPVTGRCVSALGRRFHPDHFTCTFCLRPLTKGSFQERAGKPYCQPCFLKLFG

SEQ ID NO: 65801 - DNA, 20 bp, Homo sapiens
gatcgtgcagacaatgaaca

SEQ ID NO: 65802 - DNA, 20 bp, Homo sapiens
gatctagctcacagagcccg

SEQ ID NO: 65803 - protein, 18 aa, Homo sapiens
AIGISNFNHLQVEMILNK

SEQ ID NO: 65804 - protein, 22 aa, Homo sapiens
AIGISNFNHLQVEMILNKPGLK

SEQ ID NO: 65805 - protein, 15 aa, Homo sapiens
DLYLIHWPTGFKPGK

SEQ ID NO: 65806 - protein, 8 aa, Homo sapiens
DYPFHEEF

SEQ ID NO: 65807 - protein, 35 aa, Homo sapiens
EFFPLDESGNVVPSDTNILDTWAAMEELVDEGLVK

SEQ ID NO: 65808 - protein, 20 aa, Homo sapiens
GISNFNHLQVEMILNKPGLK

SEQ ID NO: 65809 - protein, 30 aa, Homo sapiens
GIVVTAYSPLGSPDRPWAKPEDPSLLEDPR

SEQ ID NO: 65810 - protein, 21 aa, Homo sapiens
HIDCAHVYQNENEVGVAIQEK

SEQ ID NO: 65811 - protein, 14 aa, Homo sapiens
HLQVEMILNKPGLK

SEQ ID NO: 65812 - protein, 16 aa, Homo sapiens
LDYLDLYLIHWPTGFK

SEQ ID NO: 65813 - protein, 19 aa, Homo sapiens
LDYLDLYLIHWPTGFKPGK

SEQ ID NO: 65814 - protein, 8 aa, Homo sapiens
LIQYCQSK

SEQ ID NO: 65815 - protein, 8 aa, Homo sapiens
LWCTYHEK

SEQ ID NO: 65816 - protein, 10 aa, Homo sapiens
MPILGLGTWK

SEQ ID NO: 65817 - protein, 7 aa, Homo sapiens
NLVVIPK

SEQ ID NO: 65818 - protein, 16 aa, Homo sapiens
PAVNQIECHPYLTQEK

SEQ ID NO: 65819 - protein, 23 aa, Homo sapiens
PSDTNILDTWAAMEELVDEGLVK

SEQ ID NO: 65820 - protein, 12 aa, Homo sapiens
QIECHPYLTQEK

SEQ ID NO: 65821 - protein, 13 aa, Homo sapiens
QNENEVGVAIQEK

SEQ ID NO: 65822 - protein, 9 aa, Homo sapiens
REELFIVSK

SEQ ID NO: 65823 - protein, 11 aa, Homo sapiens
SPPGQVTEAVK

SEQ ID NO: 65824 - protein, 25 aa, Homo sapiens
TLSDLKLDYLDLYLIHWPTGFKPGK

SEQ ID NO: 65825 - protein, 8 aa, Homo sapiens
TTAQVLIR

SEQ ID NO: 65826 - protein, 8 aa, Homo sapiens
VAIDVGYR

SEQ ID NO: 65827 - protein, 11 aa, Homo sapiens
VCALLSCTSHK

SEQ ID NO: 65828 - protein, 19 aa, Homo sapiens
VCALLSCTSHKDYPFHEEF

SEQ ID NO: 65829 - protein, 19 aa, Homo sapiens
VFDFELSSQDMTTLLSYNR

SEQ ID NO: 65830 - protein, 24 aa, Homo sapiens
VPSDTNILDTWAAMEELVDEGLVK

SEQ ID NO: 65831 - protein, 13 aa, Homo sapiens
YKPAVNQIECHPY

SEQ ID NO: 65832 - protein, 18 aa, Homo sapiens
YKPAVNQIECHPYLTQEK

SEQ ID NO: 65833 - protein, 12 aa, Homo sapiens
TGHSILHTLYGR

SEQ ID NO: 65834 - protein, 8 aa, Homo sapiens
WHFYDTVK

SEQ ID NO: 65835 - protein, 12 aa, Homo sapiens
AAAATGTIFTFR

SEQ ID NO: 65836 - protein, 10 aa, Homo sapiens
AKWETSFNHK

SEQ ID NO: 65837 - protein, 34 aa, Homo sapiens
ALASAAPSQNIFFSPVSISMSLAMLSLGAGSSTK

SEQ ID NO: 65838 - protein, 11 aa, Homo sapiens
AVVEVDESGTR

SEQ ID NO: 65839 - protein, 8 aa, Homo sapiens
DFTFDLYR

SEQ ID NO: 65840 - protein, 7 aa, Homo sapiens
DSAGAMK

SEQ ID NO: 65841 - protein, 10 aa, Homo sapiens
EDQYHYLLDR

SEQ ID NO: 65842 - protein, 15 aa, Homo sapiens
EDQYHYLLDRNLSCR

SEQ ID NO: 65843 - protein, 11 aa, Homo sapiens
FSIEGSYQLEK

SEQ ID NO: 65844 - protein, 13 aa, Homo sapiens
GFQQLLQELNQPR

SEQ ID NO: 65845 - protein, 8 aa, Homo sapiens
GKIVDLLK

SEQ ID NO: 65846 - protein, 16 aa, Homo sapiens
GTQEQDFYVTSETVVR

SEQ ID NO: 65847 - protein, 6 aa, Homo sapiens
IVDLLK

SEQ ID NO: 65848 - protein, 11 aa, Homo sapiens
IVDNNILFLGK

SEQ ID NO: 65849 - protein, 36 aa, Homo sapiens
KVLPSLGISNVFTSHADLSGISNHSNIQVSEMVHKA

SEQ ID NO: 65850 - protein, 27 aa, Homo sapiens
LPSLGISNVFTSHADLSGISNHSNIQV

SEQ ID NO: 65851 - protein, 13 aa, Homo sapiens
MQILEGLGLNLQK

SEQ ID NO: 65852 - protein, 11 aa, Homo sapiens
MQQVENGLSEK

SEQ ID NO: 65853 - protein, 17 aa, Homo sapiens
NLDSNAVVIMVNYIFFK

SEQ ID NO: 65854 - protein, 17 aa, Homo sapiens
PYQGNATALFILPSEGK

SEQ ID NO: 65855 - protein, 8 aa, Homo sapiens
QINDYVAK

SEQ ID NO: 65856 - protein, 8 aa, Homo sapiens
QLELYLPK

SEQ ID NO: 65857 - protein, 9 aa, Homo sapiens
RDFTFDLYR

SEQ ID NO: 65858 - protein, 17 aa, Homo sapiens
REDQYHYLLDRNLSCRV

SEQ ID NO: 65859 - protein, 17 aa, Homo sapiens
RPFLMFIVDNNILFLGK

SEQ ID NO: 65860 - protein, 23 aa, Homo sapiens
RVVGVPYQGNATALFILPSEGKM

SEQ ID NO: 65861 - protein, 8 aa, Homo sapiens
SARLNSQR

SEQ ID NO: 65862 - protein, 8 aa, Homo sapiens
SSEKELHR

SEQ ID NO: 65863 - protein, 21 aa, Homo sapiens
SSEKELHRGFQQLLQELNQPR

SEQ ID NO: 65864 - protein, 13 aa, Homo sapiens
TLYLADTFPTNFR

SEQ ID NO: 65865 - protein, 15 aa, Homo sapiens
VEDLHVGATVAPSSR

SEQ ID NO: 65866 - protein, 11 aa, Homo sapiens
VLPSLGISNVF

SEQ ID NO: 65867 - protein, 14 aa, Homo sapiens
VLPSLGISNVFTSH

SEQ ID NO: 65868 - protein, 34 aa, Homo sapiens
VLPSLGISNVFTSHADLSGISNHSNIQVSEMVHK

SEQ ID NO: 65869 - protein, 21 aa, Homo sapiens
VVGVPYQGNATALFILPSEGK

SEQ ID NO: 65870 - protein, 11 aa, Homo sapiens
MEDVARSSNVK

SEQ ID NO: 65871 - protein, 16 aa, Homo sapiens
RFGLLFNQENTTYSKT

SEQ ID NO: 65872 - protein, 30 aa, Homo sapiens
RKMLLWAMSVTLEQNLTCPGSDLKPFTTRL

SEQ ID NO: 65873 - protein, 16 aa, Homo sapiens
MKVKTNASQVPAEPKE

SEQ ID NO: 65874 - protein, 32 aa, Homo sapiens
RRRNVSGNNGPFGQDKNIAMTGQITSTKPKRT

SEQ ID NO: 65875 - protein, 33 aa, Homo sapiens
KSGKLNIGDQIMSINGTSLVGLPLSTCQSIIKG

SEQ ID NO: 65876 - protein, 20 aa, Homo sapiens
ILVSCNNQQDLQEWVEHLQK

SEQ ID NO: 65877 - protein, 32 aa, Homo sapiens
LSSANISYLMGNLEEICSFQQMLVQSLEECTK

SEQ ID NO: 65878 - protein, 17 aa, Homo sapiens
SVPSHTLPSHPVTPSSK

SEQ ID NO: 65879 - protein, 12 aa, Homo sapiens
MGELASESQGSK

SEQ ID NO: 65880 - protein, 32 aa, Homo sapiens
RVLLMLFHTMAQIMAEQEVENLSGLSTNPEKD

SEQ ID NO: 65881 - protein, 25 aa, Homo sapiens
KTANSSPIHFAGAQTSLPAFSPGRL

SEQ ID NO: 65882 - protein, 14 aa, Homo sapiens
MIFDFYKQNKTTRD

SEQ ID NO: 65883 - protein, 20 aa, Homo sapiens
MESSESTNTTIEDEDTKVRK

SEQ ID NO: 65884 - protein, 10 aa, Homo sapiens
AAKNEIGILK

SEQ ID NO: 65885 - protein, 22 aa, Homo sapiens
ATPATEESTVPTTQSSAMLATK

SEQ ID NO: 65886 - protein, 17 aa, Homo sapiens
GEEAAGYAQESQREEAS

SEQ ID NO: 65887 - protein, 15 aa, Homo sapiens
HPNILQLVDVFVTRK

SEQ ID NO: 65888 - protein, 16 aa, Homo sapiens
LENGLIKEPCGTPEYL

SEQ ID NO: 65889 - protein, 23 aa, Homo sapiens
LENGLIKEPCGTPEYLAPEVVGR

SEQ ID NO: 65890 - protein, 9 aa, Homo sapiens
LMEVEQDQR

SEQ ID NO: 65891 - protein, 11 aa, Homo sapiens
PFGCVTLGDKK

SEQ ID NO: 65892 - protein, 23 aa, Homo sapiens
KFFFEPVPEFTLNPNFTIVDNKD

SEQ ID NO: 65893 - protein, 8 aa, Homo sapiens
ASPPATYR

SEQ ID NO: 65894 - protein, 10 aa, Homo sapiens
GFDNHSPIAK

SEQ ID NO: 65895 - protein, 12 aa, Homo sapiens
KGTEILVNSSRV

SEQ ID NO: 65896 - protein, 26 aa, Homo sapiens
RAYNRAGTGPASPSANATTMKPPPRR

SEQ ID NO: 65897 - protein, 27 aa, Homo sapiens
RVPGADAQYFVYSNESVRPYTPFEVKI

SEQ ID NO: 65898 - protein, 22 aa, Homo sapiens
TNASDLGNYSCLATSHMDFSTK

SEQ ID NO: 65899 - protein, 17 aa, Homo sapiens
TTGPGGDGIPAEVHIVR

SEQ ID NO: 65900 - protein, 14 aa, Homo sapiens
VISDTEADIGSNLR

SEQ ID NO: 65901 - protein, 19 aa, Homo sapiens
RCEALCGGNITAMNGTIYS

SEQ ID NO: 65902 - protein, 37 aa, Homo sapiens
RKQPMTLTVTSFNASTGRVNATLSNSNMELLLSGVYK

SEQ ID NO: 65903 - protein, 34 aa, Homo sapiens
RLGSYSGTTIPHLLNSTSNNLYLNFQSDISVSAA

SEQ ID NO: 65904 - protein, 17 aa, Homo sapiens
LVKGSPAWEPPANDTRE

SEQ ID NO: 65905 - protein, 20 aa, Homo sapiens
RLPTLLRNETGQGPVDLSDP

SEQ ID NO: 65906 - protein, 18 aa, Homo sapiens
RLQNSQCYNWTLLLGNRW

SEQ ID NO: 65907 - protein, 11 aa, Homo sapiens
SGGKQGERIYR

SEQ ID NO: 65908 - protein, 12 aa, Homo sapiens
WGGGYEGENLMK

SEQ ID NO: 65909 - protein, 23 aa, Homo sapiens
RRPLVLQLVNATTEYAEFLHCKG

SEQ ID NO: 65910 - protein, 28 aa, Homo sapiens
KAENDENGQAENFSMDPQLERQVETIRN

SEQ ID NO: 65911 - protein, 30 aa, Homo sapiens
KLCDMHLQAENYTEAAFTLLLYCELLQWED

SEQ ID NO: 65912 - protein, 24 aa, Homo sapiens
RYMIYEFWENSSVWNSHLQTNYSK

SEQ ID NO: 65913 - protein, 14 aa, Homo sapiens
KKPKGINSNSTANL

SEQ ID NO: 65914 - protein, 26 aa, Homo sapiens
KASMTPGLHPGSTLIPMNNISVPQED

SEQ ID NO: 65915 - protein, 28 aa, Homo sapiens
KWYLENVYPEMRVYNNTLTYGEVRNSKA

SEQ ID NO: 65916 - protein, 21 aa, Homo sapiens
ASTDNSPSSKAEDAPAKEEPK

SEQ ID NO: 65917 - protein, 28 aa, Homo sapiens
ATAQPPTETGESSQAEENIEAVDETKPK

SEQ ID NO: 65918 - protein, 20 aa, Homo sapiens
ESARQDEGKEEEPEADQEHA

SEQ ID NO: 65919 - protein, 14 aa, Homo sapiens
KINNSTNEGMNVKK

SEQ ID NO: 65920 - protein, 17 aa, Homo sapiens
RSAKNISSMSNMNSSRM

SEQ ID NO: 65921 - protein, 23 aa, Homo sapiens
RANASFTWVASDGWGAQESIIKG

SEQ ID NO: 65922 - protein, 25 aa, Homo sapiens
RNVNFSGIAGNPVTFNENGDAPGRY

SEQ ID NO: 65923 - protein, 15 aa, Homo sapiens
ENTEFSELELQEWYK

SEQ ID NO: 65924 - protein, 19 aa, Homo sapiens
QDLRENTEFSELELQEWYK

SEQ ID NO: 65925 - protein, 28 aa, Homo sapiens
MERAPPDGPLNASGALAGDAAAAGGARG

SEQ ID NO: 65926 - protein, 22 aa, Homo sapiens
RAELDLRPHGLGLFENSSAPRE

SEQ ID NO: 65927 - protein, 16 aa, Homo sapiens
RVLAPGIYVCNATNRH

SEQ ID NO: 65928 - protein, 8 aa, Homo sapiens
APIQWEER

SEQ ID NO: 65929 - protein, 23 aa, Homo sapiens
ENTEGEYSGIEHVIVDGVVQSIK

SEQ ID NO: 65930 - protein, 10 aa, Homo sapiens
IAEFAFEYAR

SEQ ID NO: 65931 - protein, 26 aa, Homo sapiens
NLYGDILSDLCAGLIGGLGVTPSGNI

SEQ ID NO: 65932 - protein, 25 aa, Homo sapiens
SNVTAVHKANIMRMSDGLFLQKCRE

SEQ ID NO: 65933 - protein, 18 aa, Homo sapiens
TFDLYANVRPCVSIEGYK

SEQ ID NO: 65934 - protein, 15 aa, Homo sapiens
TPIAAGHPSMNLLLR

SEQ ID NO: 65935 - protein, 15 aa, Homo sapiens
RGETASLLCNISVRG

SEQ ID NO: 65936 - protein, 24 aa, Homo sapiens
RIGPGEPLELLCNVSGALPPAGRH

SEQ ID NO: 65937 - protein, 23 aa, Homo sapiens
RVAGTAVSISCNVTGYEGPAQQN

SEQ ID NO: 65938 - protein, 26 aa, Homo sapiens
RKLQGNMLLNSSMEDKMLKENPEEKL

SEQ ID NO: 65939 - protein, 11 aa, Homo sapiens
RENFTQTLPKM

SEQ ID NO: 65940 - protein, 17 aa, Homo sapiens
KANMDNGNATDINDNRS

SEQ ID NO: 65941 - protein, 20 aa, Homo sapiens
KIRDLLDVTKTNLSVHEDKN

SEQ ID NO: 65942 - protein, 29 aa, Homo sapiens
RLAGEEAALGAELCEETPVNDNSSIVVRI

SEQ ID NO: 65943 - protein, 37 aa, Homo sapiens
MGIIAVANDTNSCELSPCALLNGGCHDLCLLTPNGRV

SEQ ID NO: 65944 - protein, 37 aa, Homo sapiens
RYIGELDQSHFTCYAPVIVEPPTDLNVTEGMAAELKC

SEQ ID NO: 65945 - protein, 26 aa, Homo sapiens
KNVTESPSFSAGDNPPVLFSSDFRIS

SEQ ID NO: 65946 - protein, 26 aa, Homo sapiens
RATAFNLSVEFAPVLLLESHCAAARD

SEQ ID NO: 65947 - protein, 18 aa, Homo sapiens
RNCTLLLSNVSPELGGKY

SEQ ID NO: 65948 - protein, 22 aa, Homo sapiens
APHWTSAPLTEASAHSHPPEIK

SEQ ID NO: 65949 - protein, 24 aa, Homo sapiens
ATFSDSLLIQPTSAGSTDRLPYSK

SEQ ID NO: 65950 - protein, 24 aa, Homo sapiens
RGVSGDRDENSFSLNSSISSSARR

SEQ ID NO: 65951 - protein, 25 aa, Homo sapiens
SGTSTPTTPGSTAITPGTPPSYSSR

SEQ ID NO: 65952 - protein, 14 aa, Homo sapiens
VDHGAEIITQSPGR

SEQ ID NO: 65953 - protein, 17 aa, Homo sapiens
VGSLDNAHHVPGGGNVK

SEQ ID NO: 65954 - protein, 20 aa, Homo sapiens
NEIVTETSPFAPAFLQPDDK

SEQ ID NO: 65955 - protein, 13 aa, Homo sapiens
GVDAQGTLSKIFK

SEQ ID NO: 65956 - protein, 14 aa, Homo sapiens
NIVTPRTPPPSQGK

SEQ ID NO: 65957 - protein, 17 aa, Homo sapiens
SAHKGFKGVDAQGTLSK

SEQ ID NO: 65958 - protein, 20 aa, Homo sapiens
SAHKGFKGVDAQGTLSKIFK

SEQ ID NO: 65959 - protein, 13 aa, Homo sapiens
SHGRTQDENPVVH

SEQ ID NO: 65960 - protein, 15 aa, Homo sapiens
SHGRTQDENPVVHFF

SEQ ID NO: 65961 - protein, 16 aa, Homo sapiens
SHGRTQDENPVVHFFK

SEQ ID NO: 65962 - protein, 10 aa, Homo sapiens
TAHYGSLPQK

SEQ ID NO: 65963 - protein, 14 aa, Homo sapiens
TAHYGSLPQKSHGR

SEQ ID NO: 65964 - protein, 13 aa, Homo sapiens
DAPGREDNTFKDR

SEQ ID NO: 65965 - protein, 10 aa, Homo sapiens
DSRSGSPMAR

SEQ ID NO: 65966 - protein, 18 aa, Homo sapiens
TQDENPVVHFFKNIVTPR

SEQ ID NO: 65967 - protein, 21 aa, Homo sapiens
GIDCSTPCPLGTYGINCSSRC

SEQ ID NO: 65968 - protein, 18 aa, Homo sapiens
KSSISNNYLNLTFPRKRT

SEQ ID NO: 65969 - protein, 6 aa, Homo sapiens
EPALNQ

SEQ ID NO: 65970 - protein, 12 aa, Homo sapiens
KEVCQLLPFLVR

SEQ ID NO: 65971 - protein, 26 aa, Homo sapiens
MSCCDLAAAGQLGKASIMASDCEPAL

SEQ ID NO: 65972 - protein, 13 aa, Homo sapiens
GKSPVSKSPVEEK

SEQ ID NO: 65973 - protein, 13 aa, Homo sapiens
SPVEEKGKSPVPK

SEQ ID NO: 65974 - protein, 26 aa, Homo sapiens
SPVEEKGKSPVPKSPVEEKGKSPVPK

SEQ ID NO: 65975 - protein, 30 aa, Homo sapiens
TDISTALKEIRSQLESHSDQNMHQAEEWFK

SEQ ID NO: 65976 - protein, 11 aa, Homo sapiens
VEAPKLKVQHK

SEQ ID NO: 65977 - protein, 12 aa, Homo sapiens
ADQDTIRELTGK

SEQ ID NO: 65978 - protein, 15 aa, Homo sapiens
ADQDTIRELTGKLGR

SEQ ID NO: 65979 - protein, 24 aa, Homo sapiens
DAAGAAPGEREELLLLQSTAEQLR

SEQ ID NO: 65980 - protein, 13 aa, Homo sapiens
IIASVPLAASPAR

SEQ ID NO: 65981 - protein, 14 aa, Homo sapiens
IRADQDTIRELTGK

SEQ ID NO: 65982 - protein, 17 aa, Homo sapiens
IRADQDTIRELTGKLGR

SEQ ID NO: 65983 - protein, 32 aa, Homo sapiens
LHGAGGSAGPPALPGAPAASAHPLPPGPLFSR

SEQ ID NO: 65984 - protein, 19 aa, Homo sapiens
PGAPAASAHPLPPGPLFSR

SEQ ID NO: 65985 - protein, 25 aa, Homo sapiens
RALPGGADNASVASGAAASPGPQRS

SEQ ID NO: 65986 - protein, 22 aa, Homo sapiens
RVNLSAAPAPVSAVPTGLHSKM

SEQ ID NO: 65987 - protein, 36 aa, Homo sapiens
SLSALHGAGGSAGPPALPGAPAASAHPLPPGPLFSR

SEQ ID NO: 65988 - protein, 24 aa, Homo sapiens
VAELEHGSSAYSPPDAFKISIPIR

SEQ ID NO: 65989 - protein, 30 aa, Homo sapiens
YRPPDRSAPSWNTTGEVVVTMEPEVPIKKL

SEQ ID NO: 65990 - protein, 20 aa, Homo sapiens
RNEMLEIQVFNYSKVFSNKL

SEQ ID NO: 65991 - protein, 23 aa, Homo sapiens
MASYLETMNITLKQQLVKVYEKY

SEQ ID NO: 65992 - protein, 11 aa, Homo sapiens
GEGENEAVTPK

SEQ ID NO: 65993 - protein, 31 aa, Homo sapiens
HRGEGENEAVTPKGATPAPQAGEPSPGLGAR

SEQ ID NO: 65994 - protein, 25 aa, Homo sapiens
KQFSLNWTYQECNNCSEEMFLQFRM

SEQ ID NO: 65995 - protein, 33 aa, Homo sapiens
EALDVIVSLLEEHGQGGNYFEDANSCHSFQSAY

SEQ ID NO: 65996 - protein, 34 aa, Homo sapiens
QGLEAMEEILTSSEPLDPAEVGDLFYDCVDTEIK

SEQ ID NO: 65997 - protein, 34 aa, Homo sapiens
SYAQSQGWWTGEGEFNFSEVFSPVEDHLDCGAGK

SEQ ID NO: 65998 - protein, 10 aa, Homo sapiens
ALGITEIFIK

SEQ ID NO: 65999 - protein, 12 aa, Homo sapiens
AQLVEEWANSVK

SEQ ID NO: 66000 - protein, 13 aa, Homo sapiens
AQLVEEWANSVKK

SEQ ID NO: 66001 - protein, 9 aa, Homo sapiens
EFSNMVTAK

SEQ ID NO: 66002 - protein, 14 aa, Homo sapiens
FTVEQEIDLKDVLK

SEQ ID NO: 66003 - protein, 22 aa, Homo sapiens
IANSLFVQNGFHVNEEFLQMMK

SEQ ID NO: 66004 - protein, 19 aa, Homo sapiens
KDANLTGLSDNKEIFLSKA

SEQ ID NO: 66005 - protein, 13 aa, Homo sapiens
KWVENNTNNLVKD

SEQ ID NO: 66006 - protein, 9 aa, Homo sapiens
NGEEFSFLK

SEQ ID NO: 66007 - protein, 13 aa, Homo sapiens
QEVPLATLEPLVK

SEQ ID NO: 66008 - protein, 9 aa, Homo sapiens
QKVEVYLPR

SEQ ID NO: 66009 - protein, 10 aa, Homo sapiens
RTGTILFMGR

SEQ ID NO: 66010 - protein, 9 aa, Homo sapiens
SQFRPENTR

SEQ ID NO: 66011 - protein, 9 aa, Homo sapiens
TGTILFMGR

SEQ ID NO: 66012 - protein, 17 aa, Homo sapiens
VMHPETMNTSGHDFEEL

SEQ ID NO: 66013 - protein, 29 aa, Homo sapiens
NGDNVEAPPVYDSYEVEYLPIEGLLSSGK

SEQ ID NO: 66014 - protein, 28 aa, Homo sapiens
REGETVTVEGLGGPDPLPLANQSFLLRG

SEQ ID NO: 66015 - protein, 9 aa, Homo sapiens
SPTHQAALR

SEQ ID NO: 66016 - protein, 21 aa, Homo sapiens
KPYQLIAQDNETEKPIDSETK

SEQ ID NO: 66017 - protein, 20 aa, Homo sapiens
TTTNVLGDSLGAGIVEHLSR

SEQ ID NO: 66018 - protein, 26 aa, Homo sapiens
KTSATSVNLSLLTADLYSLFCGLFLF

SEQ ID NO: 66019 - protein, 25 aa, Homo sapiens
NCTCVGIAASKSGNSSGIVGRCQKD

SEQ ID NO: 66020 - protein, 16 aa, Homo sapiens
KDLNETTEQDLCPLKN

SEQ ID NO: 66021 - protein, 19 aa, Homo sapiens
KMNCNNRNVSSLADLKPKL

SEQ ID NO: 66022 - protein, 23 aa, Homo sapiens
MSQHYQSGPVPGTAINGTLPLSH

SEQ ID NO: 66023 - protein, 23 aa, Homo sapiens
KMKELPLVSLFCSCFLADPLNKS

SEQ ID NO: 66024 - protein, 12 aa, Homo sapiens
RLINSTFLHNKE

SEQ ID NO: 66025 - protein, 12 aa, Homo sapiens
RFINSTFLEQKE

SEQ ID NO: 66026 - protein, 34 aa, Homo sapiens
MFPFLSFNISGLDPTAHYNIFVDVILADPNHWRF

SEQ ID NO: 66027 - protein, 33 aa, Homo sapiens
RPFIEVNIIGPQLSDKKRKFATKSKNNSWAPKY

SEQ ID NO: 66028 - protein, 10 aa, Homo sapiens
DLLHVLAFSK

SEQ ID NO: 66029 - protein, 13 aa, Homo sapiens
INDISHTQSVSSK

SEQ ID NO: 66030 - protein, 18 aa, Homo sapiens
MDQTLAVYQQILTSMPSR

SEQ ID NO: 66031 - protein, 13 aa, Homo sapiens
NVIQISNDLENLR

SEQ ID NO: 66032 - protein, 11 aa, Homo sapiens
PGLHPILTLSK

SEQ ID NO: 66033 - protein, 18 aa, Homo sapiens
VTGLDFIPGLHPILTLSK

SEQ ID NO: 66034 - protein, 8 aa, Homo sapiens
AYSNETKV

SEQ ID NO: 66035 - protein, 25 aa, Homo sapiens
RQMGGNTNTGAALNFTLSLLQKAKK

SEQ ID NO: 66036 - protein, 16 aa, Homo sapiens
MGLLRGLNVGPNATRV

SEQ ID NO: 66037 - protein, 22 aa, Homo sapiens
KMYNHSWPESLACDELPVYDRG

SEQ ID NO: 66038 - protein, 15 aa, Homo sapiens
FLADGGSADTCDQFR

SEQ ID NO: 66039 - protein, 23 aa, Homo sapiens
HALEHPEPGAEHNGLEGPNDSGR

SEQ ID NO: 66040 - protein, 23 aa, Homo sapiens
LPMDLLVLEDEKHHGAQSAALQK

SEQ ID NO: 66041 - protein, 10 aa, Homo sapiens
AIDATLMSPR

SEQ ID NO: 66042 - protein, 8 aa, Homo sapiens
APFMSQER

SEQ ID NO: 66043 - protein, 9 aa, Homo sapiens
ASGWSVQYR

SEQ ID NO: 66044 - protein, 23 aa, Homo sapiens
DLAGNSEVVAGTGEQCLPFDEAR

SEQ ID NO: 66045 - protein, 8 aa, Homo sapiens
DYDVLAGR

SEQ ID NO: 66046 - protein, 10 aa, Homo sapiens
FSEEGMVNAR

SEQ ID NO: 66047 - protein, 7 aa, Homo sapiens
GIMFAIK

SEQ ID NO: 66048 - protein, 10 aa, Homo sapiens
GSDIFEYNSK

SEQ ID NO: 66049 - protein, 37 aa, Homo sapiens
GTCQCYSGWKGAECDVPMNQCIDPSCGGHGSCIDGNC

SEQ ID NO: 66050 - protein, 13 aa, Homo sapiens
HSMSTHTSIGYIR

SEQ ID NO: 66051 - protein, 10 aa, Homo sapiens
IDDDGYLCQR

SEQ ID NO: 66052 - protein, 17 aa, Homo sapiens
IGSADGDLVTLGTTIGR

SEQ ID NO: 66053 - protein, 10 aa, Homo sapiens
IKEVQYEMFR

SEQ ID NO: 66054 - protein, 14 aa, Homo sapiens
ITMTQSTVPLNLIR

SEQ ID NO: 66055 - protein, 7 aa, Homo sapiens
LGDVQYK

SEQ ID NO: 66056 - protein, 11 aa, Homo sapiens
LLAVTMPSVAR

SEQ ID NO: 66057 - protein, 7 aa, Homo sapiens
LVHFTQR

SEQ ID NO: 66058 - protein, 15 aa, Homo sapiens
LWTEGEKQQLLSTGR

SEQ ID NO: 66059 - protein, 14 aa, Homo sapiens
MVNLQSGGFSCTIR

SEQ ID NO: 66060 - protein, 9 aa, Homo sapiens
NLLSIDYDR

SEQ ID NO: 66061 - protein, 7 aa, Homo sapiens
NYVTDVK

SEQ ID NO: 66062 - protein, 11 aa, Homo sapiens
QYIFEYDSSDR

SEQ ID NO: 66063 - protein, 19 aa, Homo sapiens
RCNISLPMENGLNSIEWRL

SEQ ID NO: 66064 - protein, 17 aa, Homo sapiens
SDETGWTTFYDYDHEGR

SEQ ID NO: 66065 - protein, 15 aa, Homo sapiens
SISCPSCNGLAEGNK

SEQ ID NO: 66066 - protein, 10 aa, Homo sapiens
SMVLLLQSQR

SEQ ID NO: 66067 - protein, 12 aa, Homo sapiens
SNNPLSSELDLK

SEQ ID NO: 66068 - protein, 8 aa, Homo sapiens
TDIDKQGR

SEQ ID NO: 66069 - protein, 8 aa, Homo sapiens
TSFLGTGR

SEQ ID NO: 66070 - protein, 13 aa, Homo sapiens
VASVLNNAYYLDK

SEQ ID NO: 66071 - protein, 12 aa, Homo sapiens
VTQEVPPGVFWR

SEQ ID NO: 66072 - protein, 14 aa, Homo sapiens
VTTGVSSIASEDSR

SEQ ID NO: 66073 - protein, 15 aa, Homo sapiens
VTTGVSSIASEDSRK

SEQ ID NO: 66074 - protein, 24 aa, Homo sapiens
VVSTQNLELGLMTYDGNTGLLATK

SEQ ID NO: 66075 - protein, 9 aa, Homo sapiens
VWSYSYLDK

SEQ ID NO: 66076 - protein, 10 aa, Homo sapiens
WTSPDYTMWK

SEQ ID NO: 66077 - protein, 12 aa, Homo sapiens
YGLTPDTLDEEK

SEQ ID NO: 66078 - protein, 7 aa, Homo sapiens
YGYTITR

SEQ ID NO: 66079 - protein, 20 aa, Homo sapiens
YYLAVDPVSGSLYVSDTNSR

SEQ ID NO: 66080 - protein, 16 aa, Homo sapiens
ACQLPPCNDEPCLGDK

SEQ ID NO: 66081 - protein, 17 aa, Homo sapiens
YREYELVTPVSTNLEGR

SEQ ID NO: 66082 - protein, 35 aa, Homo sapiens
RNHSLEPLSTFLTYMTCSYMIDNVILLMNGALQKK

SEQ ID NO: 66083 - protein, 16 aa, Homo sapiens
VYDSLLALPQDLQAAR

SEQ ID NO: 66084 - protein, 34 aa, Homo sapiens
VAAAEESTGKASQYYILLILTDGVVTDMADTREA

SEQ ID NO: 66085 - protein, 15 aa, Homo sapiens
VQLYGPTNVAPIISK

SEQ ID NO: 66086 - protein, 18 aa, Homo sapiens
AIGAVPLIQGEYMIPCEK

SEQ ID NO: 66087 - protein, 20 aa, Homo sapiens
AYWQVHLDQVEVASGLTLCK

SEQ ID NO: 66088 - protein, 18 aa, Homo sapiens
DPDAQPGGELMLGGTDSK

SEQ ID NO: 66089 - protein, 22 aa, Homo sapiens
EGCEAIVDTGTSLMVGPVDEVR

SEQ ID NO: 66090 - protein, 11 aa, Homo sapiens
FDGILGMAYPR

SEQ ID NO: 66091 - protein, 10 aa, Homo sapiens
GSLSYLNVTR

SEQ ID NO: 66092 - protein, 17 aa, Homo sapiens
ISVNNVLPVFDNLMQQK

SEQ ID NO: 66093 - protein, 12 aa, Homo sapiens
KGSLSYLNVTRK

SEQ ID NO: 66094 - protein, 19 aa, Homo sapiens
KNGTSFDIHYGSGSLSGYL

SEQ ID NO: 66095 - protein, 11 aa, Homo sapiens
LLDIACWIHHK

SEQ ID NO: 66096 - protein, 13 aa, Homo sapiens
LVDQNIFSFYLSR

SEQ ID NO: 66097 - protein, 22 aa, Homo sapiens
MGMDIPPPSGPLWILGDVFIGR

SEQ ID NO: 66098 - protein, 23 aa, Homo sapiens
PLIQGEYMIPCEKVSTLPAITLK

SEQ ID NO: 66099 - protein, 10 aa, Homo sapiens
QPGITFIAAK

SEQ ID NO: 66100 - protein, 8 aa, Homo sapiens
QVFGEATK

SEQ ID NO: 66101 - protein, 18 aa, Homo sapiens
QVFGEATKQPGITFIAAK

SEQ ID NO: 66102 - protein, 16 aa, Homo sapiens
RTMSEVGGSVEDLIAK

SEQ ID NO: 66103 - protein, 15 aa, Homo sapiens
TMSEVGGSVEDLIAK

SEQ ID NO: 66104 - protein, 20 aa, Homo sapiens
TMSEVGGSVEDLIAKGPVSK

SEQ ID NO: 66105 - protein, 19 aa, Homo sapiens
TVVFDTGSSNLWVPSIHCK

SEQ ID NO: 66106 - protein, 8 aa, Homo sapiens
VGFAEAAR

SEQ ID NO: 66107 - protein, 9 aa, Homo sapiens
VGFAEAARL

SEQ ID NO: 66108 - protein, 10 aa, Homo sapiens
VSTLPAITLK

SEQ ID NO: 66109 - protein, 18 aa, Homo sapiens
YSQAVPAVTEGPIPEVLK

SEQ ID NO: 66110 - protein, 7 aa, Homo sapiens
YYTVFDR

SEQ ID NO: 66111 - protein, 24 aa, Homo sapiens
TELQLAAVETTANSLMWILYNLSR

SEQ ID NO: 66112 - protein, 27 aa, Homo sapiens
KSLTTECHLLDSPGLNCSNPFTQLERR

SEQ ID NO: 66113 - protein, 28 aa, Homo sapiens
KVDSEENTLNSQTNATSGMNPDGVLSKM

SEQ ID NO: 66114 - protein, 32 aa, Homo sapiens
MLFLSMNLTISAGPASTLPTATPAAGELTMRS

SEQ ID NO: 66115 - protein, 24 aa, Homo sapiens
MAYPGYGGGFGNFSIQVPGMQMGQ

SEQ ID NO: 66116 - protein, 25 aa, Homo sapiens
KSSEFASIPANSSRPLSNISKSGRM

SEQ ID NO: 66117 - protein, 10 aa, Homo sapiens
ARPVINIVHK

SEQ ID NO: 66118 - protein, 17 aa, Homo sapiens
EAGNPGSLFGYSVALHR

SEQ ID NO: 66119 - protein, 19 aa, Homo sapiens
FAGSESAVFHGFFSMPEMR

SEQ ID NO: 66120 - protein, 17 aa, Homo sapiens
KLRPIIISMNYSLPLRM

SEQ ID NO: 66121 - protein, 12 aa, Homo sapiens
KNITIVTGAPRH

SEQ ID NO: 66122 - protein, 25 aa, Homo sapiens
NDPGHHIIEDMWLGVTVASQGPAGR

SEQ ID NO: 66123 - protein, 14 aa, Homo sapiens
QALENHTEVQFQKE

SEQ ID NO: 66124 - protein, 20 aa, Homo sapiens
QLDPGGGQGPPPVTLAAAKK

SEQ ID NO: 66125 - protein, 11 aa, Homo sapiens
SETVLTCATGR

SEQ ID NO: 66126 - protein, 29 aa, Homo sapiens
SLSGQMDVDENFYPDLLVGSLSDHIVLLR

SEQ ID NO: 66127 - protein, 13 aa, Homo sapiens
TGAVYLCPLTAHK

SEQ ID NO: 66128 - protein, 18 aa, Homo sapiens
TGAVYLCPLTAHKDDCER

SEQ ID NO: 66129 - protein, 7 aa, Homo sapiens
VLVCAHR

SEQ ID NO: 66130 - protein, 9 aa, Homo sapiens
VYIYHSSSK

SEQ ID NO: 66131 - protein, 20 aa, Homo sapiens
RNVTSNDEVLFNVTVTMKKC

SEQ ID NO: 66132 - protein, 24 aa, Homo sapiens
RMKRGYDNPNFILSEVNETDDTKM

SEQ ID NO: 66133 - protein, 23 aa, Homo sapiens
WRYKLTLFAATFVMTWFLFGVIY

SEQ ID NO: 66134 - protein, 14 aa, Homo sapiens
AQLLVVGSPGPVPR

SEQ ID NO: 66135 - protein, 24 aa, Homo sapiens
IQIPEEYEGHHVMEPPVITEQSPR

SEQ ID NO: 66136 - protein, 22 aa, Homo sapiens
KDHVVVPANTTSVILSGLRPYS

SEQ ID NO: 66137 - protein, 38 aa, Homo sapiens
KGPEPQVTIGYSGEDYPQAIPELEGIEILNSSAVLVKW

SEQ ID NO: 66138 - protein, 20 aa, Homo sapiens
KILTADNQTYMAVQGSTAYL

SEQ ID NO: 66139 - protein, 13 aa, Homo sapiens
KVPGNQTSTTLKL

SEQ ID NO: 66140 - protein, 16 aa, Homo sapiens
LDCQVQGRPQPEVTWR

SEQ ID NO: 66141 - protein, 15 aa, Homo sapiens
LVLSDLHLLTQSQVR

SEQ ID NO: 66142 - protein, 14 aa, Homo sapiens
RFFPYANGTLGIRD

SEQ ID NO: 66143 - protein, 36 aa, Homo sapiens
RLLFPTNSSSHLVALQGQPLVLECIAEGFPTPTIKW

SEQ ID NO: 66144 - protein, 14 aa, Homo sapiens
RTHNLTDLSPHLRY

SEQ ID NO: 66145 - protein, 19 aa, Homo sapiens
RYFCLAANDQNNVTIMANL

SEQ ID NO: 66146 - protein, 37 aa, Homo sapiens
KGCGINECHDPSISGCDHNCTDTLTSFYCSCRPGYKL

SEQ ID NO: 66147 - protein, 20 aa, Homo sapiens
KYDGSNRQTLVNTTHRPFDI

SEQ ID NO: 66148 - protein, 29 aa, Homo sapiens
RCIPQSWVCDGDVDCTDGYDENQNCTRRT

SEQ ID NO: 66149 - protein, 9 aa, Homo sapiens
DLPHITVDR

SEQ ID NO: 66150 - protein, 20 aa, Homo sapiens
AAVEALQSQALHATSQQPLR

SEQ ID NO: 66151 - protein, 16 aa, Homo sapiens
LRPQTYDLQESNVQLK

SEQ ID NO: 66152 - protein, 13 aa, Homo sapiens
RKNKSVWITISST

SEQ ID NO: 66153 - protein, 16 aa, Homo sapiens
SSTNFTSPVIEFWERN

SEQ ID NO: 66154 - protein, 14 aa, Homo sapiens
MDKMFLNNTTTNRH

SEQ ID NO: 66155 - protein, 26 aa, Homo sapiens
MEDVQSVEDANNSGMNLLDQSVIKKV

SEQ ID NO: 66156 - protein, 16 aa, Homo sapiens
LGLNLSEGDGEEVYHF

SEQ ID NO: 66157 - protein, 31 aa, Homo sapiens
RSPAAAILELFEEQNGSLQELHYLMTVMERL

SEQ ID NO: 66158 - protein, 23 aa, Homo sapiens
AAPPPPVLMHHGESSQVLHPGNK

SEQ ID NO: 66159 - protein, 22 aa, Homo sapiens
APPPPVLMHHGESSQVLHPGNK

SEQ ID NO: 66160 - protein, 25 aa, Homo sapiens
APVELILSDETLPAPEFSPEPESGR

SEQ ID NO: 66161 - protein, 11 aa, Homo sapiens
APVSWITPGLK

SEQ ID NO: 66162 - protein, 13 aa, Homo sapiens
AQEPVHLDSPAIK

SEQ ID NO: 66163 - protein, 25 aa, Homo sapiens
AQEPVHLDSPAIKHQFLLTGDTQGR

SEQ ID NO: 66164 - protein, 16 aa, Homo sapiens
ATFPVHQPGNYSCSYR

SEQ ID NO: 66165 - protein, 11 aa, Homo sapiens
ATWSGAVLAGR

SEQ ID NO: 66166 - protein, 16 aa, Homo sapiens
ATWSGAVLAGRDAVLR

SEQ ID NO: 66167 - protein, 13 aa, Homo sapiens
AVALGDGGHYTCR

SEQ ID NO: 66168 - protein, 14 aa, Homo sapiens
CEGPIPDVTFELLR

SEQ ID NO: 66169 - protein, 19 aa, Homo sapiens
CEGPIPDVTFELLREGETK

SEQ ID NO: 66170 - protein, 9 aa, Homo sapiens
CLAPLEGAR

SEQ ID NO: 66171 - protein, 14 aa, Homo sapiens
CRSGLSTGWTQLSK

SEQ ID NO: 66172 - protein, 19 aa, Homo sapiens
DAVLRCEGPIPDVTFELLR

SEQ ID NO: 66173 - protein, 24 aa, Homo sapiens
DAVLRCEGPIPDVTFELLREGETK

SEQ ID NO: 66174 - protein, 31 aa, Homo sapiens
DHEFLEVPEAQEDVEATFPVHQPGNYSCSYR

SEQ ID NO: 66175 - protein, 14 aa, Homo sapiens
DLKPPFGGSAPSER

SEQ ID NO: 66176 - protein, 25 aa, Homo sapiens
DSANYSCVYVDLKPPFGGSAPSERL

SEQ ID NO: 66177 - protein, 19 aa, Homo sapiens
DVEATFPVHQPGNYSCSYR

SEQ ID NO: 66178 - protein, 23 aa, Homo sapiens
EAQEDVEATFPVHQPGNYSCSYR

SEQ ID NO: 66179 - protein, 17 aa, Homo sapiens
EATFPVHQPGNYSCSYR

SEQ ID NO: 66180 - protein, 20 aa, Homo sapiens
EDVEATFPVHQPGNYSCSYR

SEQ ID NO: 66181 - protein, 15 aa, Homo sapiens
EGDHEFLEVPEAQED

SEQ ID NO: 66182 - protein, 18 aa, Homo sapiens
EGDHEFLEVPEAQEDVEA

SEQ ID NO: 66183 - protein, 27 aa, Homo sapiens
EGDHEFLEVPEAQEDVEATFPVHQPGN

SEQ ID NO: 66184 - protein, 29 aa, Homo sapiens
EGDHEFLEVPEAQEDVEATFPVHQPGNYS

SEQ ID NO: 66185 - protein, 30 aa, Homo sapiens
EGDHEFLEVPEAQEDVEATFPVHQPGNYSC

SEQ ID NO: 66186 - protein, 33 aa, Homo sapiens
EGDHEFLEVPEAQEDVEATFPVHQPGNYSCSYR

SEQ ID NO: 66187 - protein, 11 aa, Homo sapiens
EGETKAVKTVR

SEQ ID NO: 66188 - protein, 13 aa, Homo sapiens
EGPIPDVTFELLR

SEQ ID NO: 66189 - protein, 14 aa, Homo sapiens
ELIFVGPQHAGNYR

SEQ ID NO: 66190 - protein, 6 aa, Homo sapiens
ELLVPR

SEQ ID NO: 66191 - protein, 15 aa, Homo sapiens
ESELSDPVELLVAES

SEQ ID NO: 66192 - protein, 26 aa, Homo sapiens
EVPEAQEDVEATFPVHQPGNYSCSYR

SEQ ID NO: 66193 - protein, 8 aa, Homo sapiens
FALVREDR

SEQ ID NO: 66194 - protein, 11 aa, Homo sapiens
FALVREDRGGR

SEQ ID NO: 66195 - protein, 33 aa, Homo sapiens
FELHNISVADSANYSCVYVDLKPPFGGSAPSER

SEQ ID NO: 66196 - protein, 18 aa, Homo sapiens
FFHLNAVALGDGGHYTCR

SEQ ID NO: 66197 - protein, 14 aa, Homo sapiens
FPVHQPGNYSCSYR

SEQ ID NO: 66198 - protein, 14 aa, Homo sapiens
FQSPAGTEALFELH

SEQ ID NO: 66199 - protein, 20 aa, Homo sapiens
FQSPAGTEALFELHNISVAD

SEQ ID NO: 66200 - protein, 25 aa, Homo sapiens
FQSPAGTEALFELHNISVADSANYS

SEQ ID NO: 66201 - protein, 43 aa, Homo sapiens
FQSPAGTEALFELHNISVADSANYSCVYVDLKPPFGGSAPSER

SEQ ID NO: 66202 - protein, 11 aa, Homo sapiens
FVGPQHAGNYR

SEQ ID NO: 66203 - protein, 20 aa, Homo sapiens
GAAANLELIFVGPQHAGNYR

SEQ ID NO: 66204 - protein, 9 aa, Homo sapiens
GEKELLVPR

SEQ ID NO: 66205 - protein, 12 aa, Homo sapiens
GPIPDVTFELLR

SEQ ID NO: 66206 - protein, 15 aa, Homo sapiens
GVAQEPVHLDSPAIK

SEQ ID NO: 66207 - protein, 27 aa, Homo sapiens
GVAQEPVHLDSPAIKHQFLLTGDTQGR

SEQ ID NO: 66208 - protein, 11 aa, Homo sapiens
GVLRGVTFLLR

SEQ ID NO: 66209 - protein, 12 aa, Homo sapiens
GVLRGVTFLLRR

SEQ ID NO: 66210 - protein, 7 aa, Homo sapiens
GVTFLLR

SEQ ID NO: 66211 - protein, 8 aa, Homo sapiens
GVTFLLRR

SEQ ID NO: 66212 - protein, 31 aa, Homo sapiens
GWSGDSAPVELILSDETLPAPEFSPEPESGR

SEQ ID NO: 66213 - protein, 30 aa, Homo sapiens
HEFLEVPEAQEDVEATFPVHQPGNYSCSYR

SEQ ID NO: 66214 - protein, 13 aa, Homo sapiens
HGESSQVLHPGNK

SEQ ID NO: 66215 - protein, 14 aa, Homo sapiens
HHGESSQVLHPGNK

SEQ ID NO: 66216 - protein, 16 aa, Homo sapiens
HLNAVALGDGGHYTCR

SEQ ID NO: 66217 - protein, 12 aa, Homo sapiens
HQFLLTGDTQGR

SEQ ID NO: 66218 - protein, 12 aa, Homo sapiens
IFFHLNAVALGD

SEQ ID NO: 66219 - protein, 15 aa, Homo sapiens
IFFHLNAVALGDGGH

SEQ ID NO: 66220 - protein, 16 aa, Homo sapiens
IFFHLNAVALGDGGHY

SEQ ID NO: 66221 - protein, 17 aa, Homo sapiens
IFFHLNAVALGDGGHYT

SEQ ID NO: 66222 - protein, 19 aa, Homo sapiens
IFFHLNAVALGDGGHYTCR

SEQ ID NO: 66223 - protein, 12 aa, Homo sapiens
IFVGPQHAGNYR

SEQ ID NO: 66224 - protein, 20 aa, Homo sapiens
ILSDETLPAPEFSPEPESGR

SEQ ID NO: 66225 - protein, 11 aa, Homo sapiens
LELHVDGPPPR

SEQ ID NO: 66226 - protein, 13 aa, Homo sapiens
LELHVDGPPPRPQ

SEQ ID NO: 66227 - protein, 15 aa, Homo sapiens
LELHVDGPPPRPQLR

SEQ ID NO: 66228 - protein, 10 aa, Homo sapiens
LETPDFQLFK

SEQ ID NO: 66229 - protein, 26 aa, Homo sapiens
LETPDFQLFKNGVAQEPVHLDSPAIK

SEQ ID NO: 66230 - protein, 11 aa, Homo sapiens
LHDNQNGWSGD

SEQ ID NO: 66231 - protein, 17 aa, Homo sapiens
LHDNQNGWSGDSAPVEL

SEQ ID NO: 66232 - protein, 37 aa, Homo sapiens
LHDNQNGWSGDSAPVELILSDETLPAPEFSPEPESGR

SEQ ID NO: 66233 - protein, 13 aa, Homo sapiens
LIFVGPQHAGNYR

SEQ ID NO: 66234 - protein, 8 aa, Homo sapiens
LLELTGPK

SEQ ID NO: 66235 - protein, 28 aa, Homo sapiens
LLELTGPKSLPAPWLSMAPVSWITPGLK

SEQ ID NO: 66236 - protein, 11 aa, Homo sapiens
LRCLAPLEGAR

SEQ ID NO: 66237 - protein, 14 aa, Homo sapiens
LSMAPVSWITPGLK

SEQ ID NO: 66238 - protein, 12 aa, Homo sapiens
MAPVSWITPGLK

SEQ ID NO: 66239 - protein, 15 aa, Homo sapiens
MHHGESSQVLHPGNK

SEQ ID NO: 66240 - protein, 14 aa, Homo sapiens
NGVAQEPVHLDSPA

SEQ ID NO: 66241 - protein, 16 aa, Homo sapiens
NGVAQEPVHLDSPAIK

SEQ ID NO: 66242 - protein, 28 aa, Homo sapiens
NGVAQEPVHLDSPAIKHQFLLTGDTQGR

SEQ ID NO: 66243 - protein, 30 aa, Homo sapiens
NGVAQEPVHLDSPAIKHQFLLTGDTQGRYR

SEQ ID NO: 66244 - protein, 16 aa, Homo sapiens
NLELIFVGPQHAGNYR

SEQ ID NO: 66245 - protein, 13 aa, Homo sapiens
PAPEFSPEPESGR

SEQ ID NO: 66246 - protein, 18 aa, Homo sapiens
PAPWLSMAPVSWITPGLK

SEQ ID NO: 66247 - protein, 23 aa, Homo sapiens
PDFQLFKNGVAQEPVHLDSPAIK

SEQ ID NO: 66248 - protein, 9 aa, Homo sapiens
PDVTFELLR

SEQ ID NO: 66249 - protein, 17 aa, Homo sapiens
PDVTFELLREGETKAVK

SEQ ID NO: 66250 - protein, 24 aa, Homo sapiens
PEAQEDVEATFPVHQPGNYSCSYR

SEQ ID NO: 66251 - protein, 21 aa, Homo sapiens
PGAAANLELIFVGPQHAGNYR

SEQ ID NO: 66252 - protein, 9 aa, Homo sapiens
PGNYSCSYR

SEQ ID NO: 66253 - protein, 10 aa, Homo sapiens
PLSGVDFQLR

SEQ ID NO: 66254 - protein, 11 aa, Homo sapiens
PPFGGSAPSER

SEQ ID NO: 66255 - protein, 21 aa, Homo sapiens
PPPPVLMHHGESSQVLHPGNK

SEQ ID NO: 66256 - protein, 20 aa, Homo sapiens
PPPVLMHHGESSQVLHPGNK

SEQ ID NO: 66257 - protein, 22 aa, Homo sapiens
PVHLDSPAIKHQFLLTGDTQGR

SEQ ID NO: 66258 - protein, 13 aa, Homo sapiens
PVHQPGNYSCSYR

SEQ ID NO: 66259 - protein, 10 aa, Homo sapiens
PVSWITPGLK

SEQ ID NO: 66260 - protein, 16 aa, Homo sapiens
PWLSMAPVSWITPGLK

SEQ ID NO: 66261 - protein, 21 aa, Homo sapiens
QEDVEATFPVHQPGNYSCSYR

SEQ ID NO: 66262 - protein, 34 aa, Homo sapiens
REGDHEFLEVPEAQEDVEATFPVHQPGNYSCSYR

SEQ ID NO: 66263 - protein, 35 aa, Homo sapiens
REGDHEFLEVPEAQEDVEATFPVHQPGNYSCSYRT

SEQ ID NO: 66264 - protein, 19 aa, Homo sapiens
RFQSPAGTEALFELHNISV

SEQ ID NO: 66265 - protein, 45 aa, Homo sapiens
RFQSPAGTEALFELHNISVADSANYSCVYVDLKPPFGGSAPSERL

SEQ ID NO: 66266 - protein, 10 aa, Homo sapiens
RGEKELLVPR

SEQ ID NO: 66267 - protein, 23 aa, Homo sapiens
SANYSCVYVDLKPPFGGSAPSER

SEQ ID NO: 66268 - protein, 18 aa, Homo sapiens
SDETLPAPEFSPEPESGR

SEQ ID NO: 66269 - protein, 29 aa, Homo sapiens
SGDSAPVELILSDETLPAPEFSPEPESGR

SEQ ID NO: 66270 - protein, 10 aa, Homo sapiens
SGLSTGWTQL

SEQ ID NO: 66271 - protein, 12 aa, Homo sapiens
SGLSTGWTQLSK

SEQ ID NO: 66272 - protein, 20 aa, Homo sapiens
SGLSTGWTQLSKLLELTGPK

SEQ ID NO: 66273 - protein, 8 aa, Homo sapiens
SGVDFQLR

SEQ ID NO: 66274 - protein, 13 aa, Homo sapiens
SLPAPWLSMAPVS

SEQ ID NO: 66275 - protein, 20 aa, Homo sapiens
SLPAPWLSMAPVSWITPGLK

SEQ ID NO: 66276 - protein, 26 aa, Homo sapiens
SLPAPWLSMAPVSWITPGLKTTAVCR

SEQ ID NO: 66277 - protein, 13 aa, Homo sapiens
SMAPVSWITPGLK

SEQ ID NO: 66278 - protein, 41 aa, Homo sapiens
SPAGTEALFELHNISVADSANYSCVYVDLKPPFGGSAPSER

SEQ ID NO: 66279 - protein, 23 aa, Homo sapiens
SSTSPDRIFFHLNAVALGDGGHY

SEQ ID NO: 66280 - protein, 26 aa, Homo sapiens
SSTSPDRIFFHLNAVALGDGGHYTCR

SEQ ID NO: 66281 - protein, 9 aa, Homo sapiens
STGWTQLSK

SEQ ID NO: 66282 - protein, 12 aa, Homo sapiens
SWVPHTFESELS

SEQ ID NO: 66283 - protein, 13 aa, Homo sapiens
SWVPHTFESELSD

SEQ ID NO: 66284 - protein, 22 aa, Homo sapiens
SWVPHTFESELSDPVELLVAES

SEQ ID NO: 66285 - protein, 14 aa, Homo sapiens
TCVAPLSGVDFQLR

SEQ ID NO: 66286 - protein, 42 aa, Homo sapiens
TDGEGALSEPSATVTIEELAAPPPPVLMHHGESSQVLHPGNK

SEQ ID NO: 66287 - protein, 17 aa, Homo sapiens
TFESELSDPVELLVAES

SEQ ID NO: 66288 - protein, 15 aa, Homo sapiens
TFPVHQPGNYSCSYR

SEQ ID NO: 66289 - protein, 15 aa, Homo sapiens
TLPAPEFSPEPESGR

SEQ ID NO: 66290 - protein, 8 aa, Homo sapiens
TPDFQLFK

SEQ ID NO: 66291 - protein, 17 aa, Homo sapiens
TPGAAANLELIFVGPQH

SEQ ID NO: 66292 - protein, 18 aa, Homo sapiens
TPGAAANLELIFVGPQHA

SEQ ID NO: 66293 - protein, 19 aa, Homo sapiens
TPGAAANLELIFVGPQHAG

SEQ ID NO: 66294 - protein, 20 aa, Homo sapiens
TPGAAANLELIFVGPQHAGN

SEQ ID NO: 66295 - protein, 22 aa, Homo sapiens
TPGAAANLELIFVGPQHAGNYR

SEQ ID NO: 66296 - protein, 25 aa, Homo sapiens
TVRTPGAAANLELIFVGPQHAGNYR

SEQ ID NO: 66297 - protein, 12 aa, Homo sapiens
VAPLSGVDFQLR

SEQ ID NO: 66298 - protein, 14 aa, Homo sapiens
VAQEPVHLDSPAIK

SEQ ID NO: 66299 - protein, 15 aa, Homo sapiens
VDLKPPFGGSAPSER

SEQ ID NO: 66300 - protein, 18 aa, Homo sapiens
VEATFPVHQPGNYSCSYR

SEQ ID NO: 66301 - protein, 10 aa, Homo sapiens
VGPQHAGNYR

SEQ ID NO: 66302 - protein, 25 aa, Homo sapiens
VPEAQEDVEATFPVHQPGNYSCSYR

SEQ ID NO: 66303 - protein, 17 aa, Homo sapiens
VTLTCVAPLSGVDFQLR

SEQ ID NO: 66304 - protein, 18 aa, Homo sapiens
VTLTCVAPLSGVDFQLRR

SEQ ID NO: 66305 - protein, 17 aa, Homo sapiens
VYVDLKPPFGGSAPSER

SEQ ID NO: 66306 - protein, 24 aa, Homo sapiens
YRSWVPHTFESELSDPVELLVAES

SEQ ID NO: 66307 - protein, 19 aa, Homo sapiens
HGCAFLVDEVQTGGGCTGK

SEQ ID NO: 66308 - protein, 43 aa, Homo sapiens
VRGRGTFCSFDTPDDSIRNKLILIARNKGVVLGGCGDKSIRFR

SEQ ID NO: 66309 - protein, 21 aa, Homo sapiens
KFVDTAGNFSFPVNFSLSLLN

SEQ ID NO: 66310 - protein, 33 aa, Homo sapiens
MSWFDDHKNSTGALSTRLATDAAQVQGATGTRL

SEQ ID NO: 66311 - protein, 22 aa, Homo sapiens
LFDFQGLQHQVAHVATQLEAAR

SEQ ID NO: 66312 - protein, 21 aa, Homo sapiens
VDASVAVFCEIQNTLINTLIR

SEQ ID NO: 66313 - protein, 24 aa, Homo sapiens
VIVGVPPDSQNLSMNPMLLLTGRT

SEQ ID NO: 66314 - protein, 10 aa, Homo sapiens
GDVLDCLQDG

SEQ ID NO: 66315 - protein, 14 aa, Homo sapiens
GQEQEVCFAEEGQK

SEQ ID NO: 66316 - protein, 14 aa, Homo sapiens
AAMVGMLANFLGFR

SEQ ID NO: 66317 - protein, 16 aa, Homo sapiens
ADSQAQLLLSTVVGVF

SEQ ID NO: 66318 - protein, 22 aa, Homo sapiens
ADSQAQLLLSTVVGVFTAPGLH

SEQ ID NO: 66319 - protein, 24 aa, Homo sapiens
ADSQAQLLLSTVVGVFTAPGLHLK

SEQ ID NO: 66320 - protein, 17 aa, Homo sapiens
AGKPKDPTFIPAPIQAK

SEQ ID NO: 66321 - protein, 15 aa, Homo sapiens
AILGVPWKDKNCTSR

SEQ ID NO: 66322 - protein, 12 aa, Homo sapiens
ALQDQLVLVAAK

SEQ ID NO: 66323 - protein, 20 aa, Homo sapiens
ALQDQLVLVAAKLDTEDKLR

SEQ ID NO: 66324 - protein, 10 aa, Homo sapiens
ALYTPVVLPR

SEQ ID NO: 66325 - protein, 19 aa, Homo sapiens
ANAGKPKDPTFIPAPIQAK

SEQ ID NO: 66326 - protein, 17 aa, Homo sapiens
AQAELPAILHTELNLQK

SEQ ID NO: 66327 - protein, 14 aa, Homo sapiens
ASLYLGALDHTADR

SEQ ID NO: 66328 - protein, 20 aa, Homo sapiens
AVFGTLASLYLGALDHTADR

SEQ ID NO: 66329 - protein, 15 aa, Homo sapiens
AVYDQSATALHFLGR

SEQ ID NO: 66330 - protein, 11 aa, Homo sapiens
DFTELDVAAEK

SEQ ID NO: 66331 - protein, 12 aa, Homo sapiens
DPTFIPAPIQAK

SEQ ID NO: 66332 - protein, 9 aa, Homo sapiens
DQLVLVAAK

SEQ ID NO: 66333 - protein, 12 aa, Homo sapiens
DQSATALHFLGR

SEQ ID NO: 66334 - protein, 10 aa, Homo sapiens
DRVYIHPFHL

SEQ ID NO: 66335 - protein, 17 aa, Homo sapiens
DRVYIHPFHLVIHNEST

SEQ ID NO: 66336 - protein, 23 aa, Homo sapiens
DRVYIHPFHLVIHNESTCEQLAK

SEQ ID NO: 66337 - protein, 19 aa, Homo sapiens
EPTESTQQLNKPEVLEVTL

SEQ ID NO: 66338 - protein, 20 aa, Homo sapiens
EPTESTQQLNKPEVLEVTLN

SEQ ID NO: 66339 - protein, 21 aa, Homo sapiens
EPTESTQQLNKPEVLEVTLNR

SEQ ID NO: 66340 - protein, 23 aa, Homo sapiens
EPTESTQQLNKPEVLEVTLNRPF

SEQ ID NO: 66341 - protein, 25 aa, Homo sapiens
EPTESTQQLNKPEVLEVTLNRPFLF

SEQ ID NO: 66342 - protein, 16 aa, Homo sapiens
FAVYDQSATALHFLGR

SEQ ID NO: 66343 - protein, 16 aa, Homo sapiens
FHLVIHNESTCEQLAK

SEQ ID NO: 66344 - protein, 9 aa, Homo sapiens
FMQAVTGWK

SEQ ID NO: 66345 - protein, 11 aa, Homo sapiens
GFSLLAEPQEF

SEQ ID NO: 66346 - protein, 17 aa, Homo sapiens
GTLASLYLGALDHTADR

SEQ ID NO: 66347 - protein, 15 aa, Homo sapiens
HLVIHNESTCEQLAK

SEQ ID NO: 66348 - protein, 18 aa, Homo sapiens
HPFHLVIHNESTCEQLAK

SEQ ID NO: 66349 - protein, 14 aa, Homo sapiens
ILGVPWKDKNCTSR

SEQ ID NO: 66350 - protein, 10 aa, Homo sapiens
ILHTELNLQK

SEQ ID NO: 66351 - protein, 9 aa, Homo sapiens
KDKNCTSRL

SEQ ID NO: 66352 - protein, 21 aa, Homo sapiens
KGFSLLAEPQEFWVDNSTSVS

SEQ ID NO: 66353 - protein, 8 aa, Homo sapiens
LANFLGFR

SEQ ID NO: 66354 - protein, 22 aa, Homo sapiens
LDAHKVLSALQAVQGLLVAQGR

SEQ ID NO: 66355 - protein, 8 aa, Homo sapiens
LDTEDKLR

SEQ ID NO: 66356 - protein, 17 aa, Homo sapiens
LFAVYDQSATALHFLGR

SEQ ID NO: 66357 - protein, 10 aa, Homo sapiens
LGALDHTADR

SEQ ID NO: 66358 - protein, 13 aa, Homo sapiens
LGVPWKDKNCTSR

SEQ ID NO: 66359 - protein, 19 aa, Homo sapiens
LLAQAELPAILHTELNLQK

SEQ ID NO: 66360 - protein, 18 aa, Homo sapiens
LLLSTVVGVFTAPGLHLK

SEQ ID NO: 66361 - protein, 22 aa, Homo sapiens
LNRPFLFAVYDQSATALHFLGR

SEQ ID NO: 66362 - protein, 10 aa, Homo sapiens
LQAILGVPWK

SEQ ID NO: 66363 - protein, 17 aa, Homo sapiens
LQAILGVPWKDKNCTSR

SEQ ID NO: 66364 - protein, 30 aa, Homo sapiens
LVLQGSYDLQDLLAQAELPAILHTELNLQK

SEQ ID NO: 66365 - protein, 12 aa, Homo sapiens
LYLGALDHTADR

SEQ ID NO: 66366 - protein, 21 aa, Homo sapiens
NRPFLFAVYDQSATALHFLGR

SEQ ID NO: 66367 - protein, 10 aa, Homo sapiens
PEVLEVTLNR

SEQ ID NO: 66368 - protein, 17 aa, Homo sapiens
PFHLVIHNESTCEQLAK

SEQ ID NO: 66369 - protein, 19 aa, Homo sapiens
PFLFAVYDQSATALHFLGR

SEQ ID NO: 66370 - protein, 14 aa, Homo sapiens
PKDPTFIPAPIQAK

SEQ ID NO: 66371 - protein, 32 aa, Homo sapiens
PQLVLQGSYDLQDLLAQAELPAILHTELNLQK

SEQ ID NO: 66372 - protein, 11 aa, Homo sapiens
PTFIPAPIQAK

SEQ ID NO: 66373 - protein, 10 aa, Homo sapiens
PWKDKNCTSR

SEQ ID NO: 66374 - protein, 12 aa, Homo sapiens
QAVQGLLVAQGR

SEQ ID NO: 66375 - protein, 10 aa, Homo sapiens
QDQLVLVAAK

SEQ ID NO: 66376 - protein, 27 aa, Homo sapiens
QGSYDLQDLLAQAELPAILHTELNLQK

SEQ ID NO: 66377 - protein, 17 aa, Homo sapiens
QPFVQGLALYTPVVLPR

SEQ ID NO: 66378 - protein, 20 aa, Homo sapiens
RPFLFAVYDQSATALHFLGR

SEQ ID NO: 66379 - protein, 23 aa, Homo sapiens
RVYIHPFHLVIHNESTCEQLAKA

SEQ ID NO: 66380 - protein, 20 aa, Homo sapiens
SDLDKVEGLTFQQNSLNWMK

SEQ ID NO: 66381 - protein, 11 aa, Homo sapiens
SIFFELEADER

SEQ ID NO: 66382 - protein, 13 aa, Homo sapiens
SLDFTELDVAAEK

SEQ ID NO: 66383 - protein, 16 aa, Homo sapiens
SLDFTELDVAAEKIDR

SEQ ID NO: 66384 - protein, 23 aa, Homo sapiens
SPTAVFGTLASLYLGALDHTADR

SEQ ID NO: 66385 - protein, 22 aa, Homo sapiens
SQAQLLLSTVVGVFTAPGLHLK

SEQ ID NO: 66386 - protein, 15 aa, Homo sapiens
STVVGVFTAPGLHLK

SEQ ID NO: 66387 - protein, 25 aa, Homo sapiens
SYDLQDLLAQAELPAILHTELNLQK

SEQ ID NO: 66388 - protein, 25 aa, Homo sapiens
TGCSLMGASVDSTLAFNTYVHFQGK

SEQ ID NO: 66389 - protein, 38 aa, Homo sapiens
TIHLTMPQLVLQGSYDLQDLLAQAELPAILHTELNLQK

SEQ ID NO: 66390 - protein, 34 aa, Homo sapiens
TMPQLVLQGSYDLQDLLAQAELPAILHTELNLQK

SEQ ID NO: 66391 - protein, 19 aa, Homo sapiens
TSPVDEKALQDQLVLVAAK

SEQ ID NO: 66392 - protein, 26 aa, Homo sapiens
TVLSPTAVFGTLASLYLGALDHTADR

SEQ ID NO: 66393 - protein, 8 aa, Homo sapiens
VANPLSTA

SEQ ID NO: 66394 - protein, 15 aa, Homo sapiens
VEGLTFQQNSLNWMK

SEQ ID NO: 66395 - protein, 17 aa, Homo sapiens
VGEVLNSIFFELEADER

SEQ ID NO: 66396 - protein, 26 aa, Homo sapiens
VGEVLNSIFFELEADEREPTESTQQL

SEQ ID NO: 66397 - protein, 28 aa, Homo sapiens
VGEVLNSIFFELEADEREPTESTQQLNK

SEQ ID NO: 66398 - protein, 6 aa, Homo sapiens
VHFQGK

SEQ ID NO: 66399 - protein, 13 aa, Homo sapiens
VIHNESTCEQLAK

SEQ ID NO: 66400 - protein, 11 aa, Homo sapiens
VLSALQAVQGL

SEQ ID NO: 66401 - protein, 12 aa, Homo sapiens
VLSALQAVQGLL

SEQ ID NO: 66402 - protein, 17 aa, Homo sapiens
VLSALQAVQGLLVAQGR

SEQ ID NO: 66403 - protein, 14 aa, Homo sapiens
VQGLALYTPVVLPR

SEQ ID NO: 66404 - protein, 15 aa, Homo sapiens
VYIHPFHLVIHNEST

SEQ ID NO: 66405 - protein, 21 aa, Homo sapiens
VYIHPFHLVIHNESTCEQLAK

SEQ ID NO: 66406 - protein, 13 aa, Homo sapiens
YDQSATALHFLGR

SEQ ID NO: 66407 - protein, 20 aa, Homo sapiens
YIHPFHLVIHNESTCEQLAK

SEQ ID NO: 66408 - protein, 9 aa, Homo sapiens
PFSFYLDIK

SEQ ID NO: 66409 - protein, 19 aa, Homo sapiens
AAFNAQNNGSNFQLEEISR

SEQ ID NO: 66410 - protein, 11 aa, Homo sapiens
AALAAFNAQNN

SEQ ID NO: 66411 - protein, 22 aa, Homo sapiens
AALAAFNAQNNGSNFQLEEISR

SEQ ID NO: 66412 - protein, 18 aa, Homo sapiens
AALVAIDYINQNLPWGYK

SEQ ID NO: 66413 - protein, 18 aa, Homo sapiens
AFNAQNNGSNFQLEEISR

SEQ ID NO: 66414 - protein, 21 aa, Homo sapiens
AGSPPDSHVLLAAPPGHQLHR

SEQ ID NO: 66415 - protein, 6 aa, Homo sapiens
AHYDLR

SEQ ID NO: 66416 - protein, 26 aa, Homo sapiens
AHYDLRHTFMGVVSLGSPSGEVSHPR

SEQ ID NO: 66417 - protein, 24 aa, Homo sapiens
AKAALAAFNAQNNGSNFQLEEISR

SEQ ID NO: 66418 - protein, 21 aa, Homo sapiens
ALAAFNAQNNGSNFQLEEISR

SEQ ID NO: 66419 - protein, 10 aa, Homo sapiens
APHGPGLIYR

SEQ ID NO: 66420 - protein, 13 aa, Homo sapiens
APLNDTRVVHAAK

SEQ ID NO: 66421 - protein, 35 aa, Homo sapiens
APPSPPLGAPGLPPAGSPPDSHVLLAAPPGHQLHR

SEQ ID NO: 66422 - protein, 14 aa, Homo sapiens
AQLVPLPPSTYVEF

SEQ ID NO: 66423 - protein, 24 aa, Homo sapiens
AQLVPLPPSTYVEFTVSGTDCVAK

SEQ ID NO: 66424 - protein, 31 aa, Homo sapiens
AQLVPLPPSTYVEFTVSGTDCVAKEATEAAK

SEQ ID NO: 66425 - protein, 15 aa, Homo sapiens
AQNNGSNFQLEEISR

SEQ ID NO: 66426 - protein, 6 aa, Homo sapiens
ATLSEK

SEQ ID NO: 66427 - protein, 26 aa, Homo sapiens
CDDPETEEAALVAIDYINQNLPWGYK

SEQ ID NO: 66428 - protein, 12 aa, Homo sapiens
CDSSPDSAEDVR

SEQ ID NO: 66429 - protein, 13 aa, Homo sapiens
CDSSPDSAEDVRK

SEQ ID NO: 66430 - protein, 7 aa, Homo sapiens
CNLLAEK

SEQ ID NO: 66431 - protein, 13 aa, Homo sapiens
CNLLAEKQYGFCK

SEQ ID NO: 66432 - protein, 11 aa, Homo sapiens
CPLLAPLNDTR

SEQ ID NO: 66433 - protein, 14 aa, Homo sapiens
CQDCPLLAPLNDTR

SEQ ID NO: 66434 - protein, 12 aa, Homo sapiens
DCPLLAPLNDTR

SEQ ID NO: 66435 - protein, 25 aa, Homo sapiens
DDPETEEAALVAIDYINQNLPWGYK

SEQ ID NO: 66436 - protein, 10 aa, Homo sapiens
DGKFSVVYAK

SEQ ID NO: 66437 - protein, 24 aa, Homo sapiens
DPETEEAALVAIDYINQNLPWGYK

SEQ ID NO: 66438 - protein, 16 aa, Homo sapiens
DTRVVHAAKAALAAFN

SEQ ID NO: 66439 - protein, 19 aa, Homo sapiens
DVRKVCQDCPLLAPLNDTR

SEQ ID NO: 66440 - protein, 7 aa, Homo sapiens
EATEAAK

SEQ ID NO: 66441 - protein, 14 aa, Homo sapiens
EATEAAKCNLLAEK

SEQ ID NO: 66442 - protein, 20 aa, Homo sapiens
EATEAAKCNLLAEKQYGFCK

SEQ ID NO: 66443 - protein, 14 aa, Homo sapiens
EHAVEGDCDFQLLK

SEQ ID NO: 66444 - protein, 18 aa, Homo sapiens
EHAVEGDCDFQLLKLDGK

SEQ ID NO: 66445 - protein, 19 aa, Homo sapiens
EIDTLETTCHVLDPTPVAR

SEQ ID NO: 66446 - protein, 17 aa, Homo sapiens
FNAQNNGSNFQLEEISR

SEQ ID NO: 66447 - protein, 7 aa, Homo sapiens
FSVVYAK

SEQ ID NO: 66448 - protein, 28 aa, Homo sapiens
GAPGLPPAGSPPDSHVLLAAPPGHQLHR

SEQ ID NO: 66449 - protein, 7 aa, Homo sapiens
GPGLIYR

SEQ ID NO: 66450 - protein, 11 aa, Homo sapiens
GSNFQLEEISR

SEQ ID NO: 66451 - protein, 11 aa, Homo sapiens
GSPSGEVSHPR

SEQ ID NO: 66452 - protein, 13 aa, Homo sapiens
GSPSGEVSHPRKT

SEQ ID NO: 66453 - protein, 16 aa, Homo sapiens
GVVSLGSPSGEVSHPR

SEQ ID NO: 66454 - protein, 8 aa, Homo sapiens
HGPGLIYR

SEQ ID NO: 66455 - protein, 14 aa, Homo sapiens
HTFMGVVSLGSPSG

SEQ ID NO: 66456 - protein, 19 aa, Homo sapiens
HTFMGVVSLGSPSGEVSHP

SEQ ID NO: 66457 - protein, 20 aa, Homo sapiens
HTFMGVVSLGSPSGEVSHPR

SEQ ID NO: 66458 - protein, 21 aa, Homo sapiens
HTFMGVVSLGSPSGEVSHPRK

SEQ ID NO: 66459 - protein, 22 aa, Homo sapiens
HTFMGVVSLGSPSGEVSHPRKT

SEQ ID NO: 66460 - protein, 10 aa, Homo sapiens
HTLNQIDEVK

SEQ ID NO: 66461 - protein, 42 aa, Homo sapiens
HTLNQIDEVKVWPQQPSGELFEIEIDTLETTCHVLDPTPVAR

SEQ ID NO: 66462 - protein, 10 aa, Homo sapiens
HVLDPTPVAR

SEQ ID NO: 66463 - protein, 10 aa, Homo sapiens
INQNLPWGYK

SEQ ID NO: 66464 - protein, 6 aa, Homo sapiens
IRHFKV

SEQ ID NO: 66465 - protein, 23 aa, Homo sapiens
KAALAAFNAQNNGSNFQLEEISR

SEQ ID NO: 66466 - protein, 24 aa, Homo sapiens
KAALAAFNAQNNGSNFQLEEISRA

SEQ ID NO: 66467 - protein, 16 aa, Homo sapiens
KVCQDCPLLAPLNDTR

SEQ ID NO: 66468 - protein, 17 aa, Homo sapiens
KVCQDCPLLAPLNDTRV

SEQ ID NO: 66469 - protein, 22 aa, Homo sapiens
KVCQDCPLLAPLNDTRVVHAAK

SEQ ID NO: 66470 - protein, 20 aa, Homo sapiens
LAAFNAQNNGSNFQLEEISR

SEQ ID NO: 66471 - protein, 11 aa, Homo sapiens
LAAPPGHQLHR

SEQ ID NO: 66472 - protein, 14 aa, Homo sapiens
LAPLNDTRVVHAAK

SEQ ID NO: 66473 - protein, 11 aa, Homo sapiens
LDGKFSVVYAK

SEQ ID NO: 66474 - protein, 12 aa, Homo sapiens
LGSPSGEVSHPR

SEQ ID NO: 66475 - protein, 16 aa, Homo sapiens
LKEHAVEGDCDFQLLK

SEQ ID NO: 66476 - protein, 12 aa, Homo sapiens
LLAAPPGHQLHR

SEQ ID NO: 66477 - protein, 15 aa, Homo sapiens
LLAPLNDTRVVHAAK

SEQ ID NO: 66478 - protein, 17 aa, Homo sapiens
MGVVSLGSPSGEVSHPR

SEQ ID NO: 66479 - protein, 16 aa, Homo sapiens
NAQNNGSNFQLEEISR

SEQ ID NO: 66480 - protein, 27 aa, Homo sapiens
NCDDPETEEAALVAIDYINQNLPWGYK

SEQ ID NO: 66481 - protein, 12 aa, Homo sapiens
NGSNFQLEEISR

SEQ ID NO: 66482 - protein, 22 aa, Homo sapiens
PAGSPPDSHVLLAAPPGHQLHR

SEQ ID NO: 66483 - protein, 37 aa, Homo sapiens
PDAPPSPPLGAPGLPPAGSPPDSHVLLAAPPGHQLHR

SEQ ID NO: 66484 - protein, 23 aa, Homo sapiens
PETEEAALVAIDYINQNLPWGYK

SEQ ID NO: 66485 - protein, 26 aa, Homo sapiens
PGLPPAGSPPDSHVLLAAPPGHQLHR

SEQ ID NO: 66486 - protein, 30 aa, Homo sapiens
PLGAPGLPPAGSPPDSHVLLAAPPGHQLHR

SEQ ID NO: 66487 - protein, 10 aa, Homo sapiens
PLLAPLNDTR

SEQ ID NO: 66488 - protein, 16 aa, Homo sapiens
PLLAPLNDTRVVHAAK

SEQ ID NO: 66489 - protein, 12 aa, Homo sapiens
PLNDTRVVHAAK

SEQ ID NO: 66490 - protein, 20 aa, Homo sapiens
PLPPSTYVEFTVSGTDCVAK

SEQ ID NO: 66491 - protein, 27 aa, Homo sapiens
PLPPSTYVEFTVSGTDCVAKEATEAAK

SEQ ID NO: 66492 - protein, 23 aa, Homo sapiens
PPAGSPPDSHVLLAAPPGHQLHR

SEQ ID NO: 66493 - protein, 18 aa, Homo sapiens
PPDSHVLLAAPPGHQLHR

SEQ ID NO: 66494 - protein, 8 aa, Homo sapiens
PPGHQLHR

SEQ ID NO: 66495 - protein, 31 aa, Homo sapiens
PPLGAPGLPPAGSPPDSHVLLAAPPGHQLHR

SEQ ID NO: 66496 - protein, 34 aa, Homo sapiens
PPSPPLGAPGLPPAGSPPDSHVLLAAPPGHQLHR

SEQ ID NO: 66497 - protein, 18 aa, Homo sapiens
PPSTYVEFTVSGTDCVAK

SEQ ID NO: 66498 - protein, 25 aa, Homo sapiens
PPSTYVEFTVSGTDCVAKEATEAAK

SEQ ID NO: 66499 - protein, 30 aa, Homo sapiens
PQQPSGELFEIEIDTLETTCHVLDPTPVAR

SEQ ID NO: 66500 - protein, 27 aa, Homo sapiens
PSGELFEIEIDTLETTCHVLDPTPVAR

SEQ ID NO: 66501 - protein, 9 aa, Homo sapiens
PSGEVSHPR

SEQ ID NO: 66502 - protein, 11 aa, Homo sapiens
PSGEVSHPRKT

SEQ ID NO: 66503 - protein, 33 aa, Homo sapiens
PSPPLGAPGLPPAGSPPDSHVLLAAPPGHQLHR

SEQ ID NO: 66504 - protein, 17 aa, Homo sapiens
PSVGAAAGPVVPPCPGR

SEQ ID NO: 66505 - protein, 26 aa, Homo sapiens
PVVDPDAPPSPPLGAPGLPPAGSPPD

SEQ ID NO: 66506 - protein, 13 aa, Homo sapiens
QDCPLLAPLNDTR

SEQ ID NO: 66507 - protein, 17 aa, Homo sapiens
QLKEHAVEGDCDFQLLK

SEQ ID NO: 66508 - protein, 21 aa, Homo sapiens
QLKEHAVEGDCDFQLLKLDGK

SEQ ID NO: 66509 - protein, 29 aa, Homo sapiens
QPNCDDPETEEAALVAIDYINQNLPWGYK

SEQ ID NO: 66510 - protein, 6 aa, Homo sapiens
QYGFCK

SEQ ID NO: 66511 - protein, 12 aa, Homo sapiens
QYGFCKATLSEK

SEQ ID NO: 66512 - protein, 15 aa, Homo sapiens
SHVLLAAPPGHQLHR

SEQ ID NO: 66513 - protein, 13 aa, Homo sapiens
SLGSPSGEVSHPR

SEQ ID NO: 66514 - protein, 10 aa, Homo sapiens
SNFQLEEISR

SEQ ID NO: 66515 - protein, 19 aa, Homo sapiens
SPPDSHVLLAAPPGHQLHR

SEQ ID NO: 66516 - protein, 10 aa, Homo sapiens
SPSGEVSHPR

SEQ ID NO: 66517 - protein, 16 aa, Homo sapiens
SVGAAAGPVVPPCPGR

SEQ ID NO: 66518 - protein, 21 aa, Homo sapiens
TEEAALVAIDYINQNLPWGYK

SEQ ID NO: 66519 - protein, 17 aa, Homo sapiens
TVSGTDCVAKEATEAAK

SEQ ID NO: 66520 - protein, 21 aa, Homo sapiens
TVVQPSVGAAAGPVVPPCPGR

SEQ ID NO: 66521 - protein, 23 aa, Homo sapiens
TVVQPSVGAAAGPVVPPCPGRIR

SEQ ID NO: 66522 - protein, 15 aa, Homo sapiens
VAIDYINQNLPWGYK

SEQ ID NO: 66523 - protein, 15 aa, Homo sapiens
VCQDCPLLAPLNDTR

SEQ ID NO: 66524 - protein, 21 aa, Homo sapiens
VCQDCPLLAPLNDTRVVHAAK

SEQ ID NO: 66525 - protein, 9 aa, Homo sapiens
VLDPTPVAR

SEQ ID NO: 66526 - protein, 13 aa, Homo sapiens
VLLAAPPGHQLHR

SEQ ID NO: 66527 - protein, 19 aa, Homo sapiens
VQPSVGAAAGPVVPPCPGR

SEQ ID NO: 66528 - protein, 21 aa, Homo sapiens
VQPSVGAAAGPVVPPCPGRIR

SEQ ID NO: 66529 - protein, 14 aa, Homo sapiens
VSLGSPSGEVSHPR

SEQ ID NO: 66530 - protein, 6 aa, Homo sapiens
VVHAAK

SEQ ID NO: 66531 - protein, 28 aa, Homo sapiens
VVHAAKAALAAFNAQNNGSNFQLEEISR

SEQ ID NO: 66532 - protein, 20 aa, Homo sapiens
VVQPSVGAAAGPVVPPCPGR

SEQ ID NO: 66533 - protein, 15 aa, Homo sapiens
VVSLGSPSGEVSHPR

SEQ ID NO: 66534 - protein, 23 aa, Homo sapiens
VWPQQPSGELFEIEIDTLETTCH

SEQ ID NO: 66535 - protein, 32 aa, Homo sapiens
VWPQQPSGELFEIEIDTLETTCHVLDPTPVAR

SEQ ID NO: 66536 - protein, 31 aa, Homo sapiens
WPQQPSGELFEIEIDTLETTCHVLDPTPVAR

SEQ ID NO: 66537 - protein, 19 aa, Homo sapiens
HIDSAYLYNNEEQVGLAIR

SEQ ID NO: 66538 - protein, 22 aa, Homo sapiens
LNDGHFMPVLGFGTYAPPEVPR

SEQ ID NO: 66539 - protein, 12 aa, Homo sapiens
AFIQLWAFDAVK

SEQ ID NO: 66540 - protein, 14 aa, Homo sapiens
AFIQLWAFDAVKGK

SEQ ID NO: 66541 - protein, 13 aa, Homo sapiens
APQLRETLLQDFR

SEQ ID NO: 66542 - protein, 21 aa, Homo sapiens
AVLPQEEEGSGGGQLVTEVTK

SEQ ID NO: 66543 - protein, 22 aa, Homo sapiens
AVLPQEEEGSGGGQLVTEVTKK

SEQ ID NO: 66544 - protein, 15 aa, Homo sapiens
CVLFPYGGCQGNGNK

SEQ ID NO: 66545 - protein, 7 aa, Homo sapiens
ECLQTCR

SEQ ID NO: 66546 - protein, 19 aa, Homo sapiens
EDSCQLGYSAGPCMGMTSR

SEQ ID NO: 66547 - protein, 8 aa, Homo sapiens
ETLLQDFR

SEQ ID NO: 66548 - protein, 15 aa, Homo sapiens
EYCGVPGDGDEELLR

SEQ ID NO: 66549 - protein, 18 aa, Homo sapiens
EYCGVPGDGDEELLRFSN

SEQ ID NO: 66550 - protein, 12 aa, Homo sapiens
FVTEKECLQTCR

SEQ ID NO: 66551 - protein, 8 aa, Homo sapiens
FYSEKECR

SEQ ID NO: 66552 - protein, 17 aa, Homo sapiens
GECVPGEQEPEPILIPR

SEQ ID NO: 66553 - protein, 14 aa, Homo sapiens
GGCMGNGNNFVTEK

SEQ ID NO: 66554 - protein, 17 aa, Homo sapiens
GKCVLFPYGGCQGNGNK

SEQ ID NO: 66555 - protein, 15 aa, Homo sapiens
GNNFVTEKECLQTCR

SEQ ID NO: 66556 - protein, 20 aa, Homo sapiens
GPVPTPPDNIQVQENFNISR

SEQ ID NO: 66557 - protein, 32 aa, Homo sapiens
GTSMACETFQYGGCMGNGNNFVTEKECLQTCR

SEQ ID NO: 66558 - protein, 12 aa, Homo sapiens
GVCEETSGAYEK

SEQ ID NO: 66559 - protein, 18 aa, Homo sapiens
GVCEETSGAYEKTDTDGK

SEQ ID NO: 66560 - protein, 9 aa, Homo sapiens
HHGPTITAK

SEQ ID NO: 66561 - protein, 27 aa, Homo sapiens
IMDRMTVSTLVLGEGATEAEISMTSTR

SEQ ID NO: 66562 - protein, 10 aa, Homo sapiens
IQLWAFDAVK

SEQ ID NO: 66563 - protein, 20 aa, Homo sapiens
KEDSCQLGYSAGPCMGMTSR

SEQ ID NO: 66564 - protein, 13 aa, Homo sapiens
KGVCEETSGAYEK

SEQ ID NO: 66565 - protein, 19 aa, Homo sapiens
KGVCEETSGAYEKTDTDGK

SEQ ID NO: 66566 - protein, 24 aa, Homo sapiens
KGVCEETSGAYEKTDTDGKFLYHK

SEQ ID NO: 66567 - protein, 25 aa, Homo sapiens
KWNITMESYVVHTNYDEYAIFLTKK

SEQ ID NO: 66568 - protein, 19 aa, Homo sapiens
LPQEEEGSGGGQLVTEVTK

SEQ ID NO: 66569 - protein, 11 aa, Homo sapiens
MGNGNNFVTEK

SEQ ID NO: 66570 - protein, 23 aa, Homo sapiens
MTVSTLVLGEGATEAEISMTSTR

SEQ ID NO: 66571 - protein, 25 aa, Homo sapiens
MTVSTLVLGEGATEAEISMTSTRWR

SEQ ID NO: 66572 - protein, 13 aa, Homo sapiens
NFVTEKECLQTCR

SEQ ID NO: 66573 - protein, 13 aa, Homo sapiens
NIQVQENFNISRI

SEQ ID NO: 66574 - protein, 11 aa, Homo sapiens
PEDSIFTMADR

SEQ ID NO: 66575 - protein, 28 aa, Homo sapiens
PEDSIFTMADRGECVPGEQEPEPILIPR

SEQ ID NO: 66576 - protein, 10 aa, Homo sapiens
PGDGDEELLR

SEQ ID NO: 66577 - protein, 13 aa, Homo sapiens
PGEQEPEPILIPR

SEQ ID NO: 66578 - protein, 15 aa, Homo sapiens
PPDNIQVQENFNISR

SEQ ID NO: 66579 - protein, 18 aa, Homo sapiens
PQEEEGSGGGQLVTEVTK

SEQ ID NO: 66580 - protein, 19 aa, Homo sapiens
PQEEEGSGGGQLVTEVTKK

SEQ ID NO: 66581 - protein, 27 aa, Homo sapiens
QENFNISRIYGKWYNLAIGSTCPWLKK

SEQ ID NO: 66582 - protein, 31 aa, Homo sapiens
RYFYNGTSMACETFQYGGCMGNGNNFVTEKE

SEQ ID NO: 66583 - protein, 25 aa, Homo sapiens
SKWNITMESYVVHTNYDEYAIFLTK

SEQ ID NO: 66584 - protein, 17 aa, Homo sapiens
SYVVHTNYDEYAIFLTK

SEQ ID NO: 66585 - protein, 11 aa, Homo sapiens
TDTDGKFLYHK

SEQ ID NO: 66586 - protein, 19 aa, Homo sapiens
TLVLGEGATEAEISMTSTR

SEQ ID NO: 66587 - protein, 12 aa, Homo sapiens
TNYDEYAIFLTK

SEQ ID NO: 66588 - protein, 11 aa, Homo sapiens
TVAACNLPIVR

SEQ ID NO: 66589 - protein, 15 aa, Homo sapiens
TVAACNLPIVRGPCR

SEQ ID NO: 66590 - protein, 17 aa, Homo sapiens
VLGEGATEAEISMTSTR

SEQ ID NO: 66591 - protein, 19 aa, Homo sapiens
VPTPPDNIQVQENFNISRI

SEQ ID NO: 66592 - protein, 14 aa, Homo sapiens
VVAQGVGIPEDSIF

SEQ ID NO: 66593 - protein, 19 aa, Homo sapiens
VVAQGVGIPEDSIFTMADR

SEQ ID NO: 66594 - protein, 36 aa, Homo sapiens
VVAQGVGIPEDSIFTMADRGECVPGEQEPEPILIPR

SEQ ID NO: 66595 - protein, 15 aa, Homo sapiens
VVHTNYDEYAIFLTK

SEQ ID NO: 66596 - protein, 23 aa, Homo sapiens
WNITMESYVVHTNYDEYAIFLTK

SEQ ID NO: 66597 - protein, 14 aa, Homo sapiens
WYNLAIGSTCPWLK

SEQ ID NO: 66598 - protein, 15 aa, Homo sapiens
WYNLAIGSTCPWLKK

SEQ ID NO: 66599 - protein, 10 aa, Homo sapiens
YDEYAIFLTK

SEQ ID NO: 66600 - protein, 29 aa, Homo sapiens
YFYNGTSMACETFQYGGCMGNGNNFVTEK

SEQ ID NO: 66601 - protein, 36 aa, Homo sapiens
YFYNGTSMACETFQYGGCMGNGNNFVTEKECLQTCR

SEQ ID NO: 66602 - protein, 16 aa, Homo sapiens
YVVHTNYDEYAIFLTK

SEQ ID NO: 66603 - protein, 10 aa, Homo sapiens
DDRYCESIMR

SEQ ID NO: 66604 - protein, 10 aa, Homo sapiens
DINTFIHGNK

SEQ ID NO: 66605 - protein, 11 aa, Homo sapiens
DINTFIHGNKR

SEQ ID NO: 66606 - protein, 18 aa, Homo sapiens
GLTSPCKDINTFIHGNKR

SEQ ID NO: 66607 - protein, 13 aa, Homo sapiens
LHGGSPWPPCQYR

SEQ ID NO: 66608 - protein, 20 aa, Homo sapiens
NVVVACENGLPVHLDQSIFR

SEQ ID NO: 66609 - protein, 9 aa, Homo sapiens
SSFQVTTCK

SEQ ID NO: 66610 - protein, 7 aa, Homo sapiens
YCESIMR

SEQ ID NO: 66611 - protein, 16 aa, Homo sapiens
YTHFLTQHYDAKPQGR

SEQ ID NO: 66612 - protein, 19 aa, Homo sapiens
YTHFLTQHYDAKPQGRDDR

SEQ ID NO: 66613 - protein, 8 aa, Homo sapiens
AELQEGAR

SEQ ID NO: 66614 - protein, 7 aa, Homo sapiens
AHVDALR

SEQ ID NO: 66615 - protein, 15 aa, Homo sapiens
AHVDALRTHLAPYSD

SEQ ID NO: 66616 - protein, 17 aa, Homo sapiens
AHVDALRTHLAPYSDEL

SEQ ID NO: 66617 - protein, 18 aa, Homo sapiens
AHVDALRTHLAPYSDELR

SEQ ID NO: 66618 - protein, 19 aa, Homo sapiens
AHVDALRTHLAPYSDELRQ

SEQ ID NO: 66619 - protein, 20 aa, Homo sapiens
AHVDALRTHLAPYSDELRQR

SEQ ID NO: 66620 - protein, 24 aa, Homo sapiens
AHVDALRTHLAPYSDELRQRLAAR

SEQ ID NO: 66621 - protein, 13 aa, Homo sapiens
AKATEHLSTLSEK

SEQ ID NO: 66622 - protein, 9 aa, Homo sapiens
AKPALEDLR

SEQ ID NO: 66623 - protein, 20 aa, Homo sapiens
AKPALEDLRQGLLPVLESFK

SEQ ID NO: 66624 - protein, 22 aa, Homo sapiens
AKPALEDLRQGLLPVLESFKVS

SEQ ID NO: 66625 - protein, 23 aa, Homo sapiens
AKPALEDLRQGLLPVLESFKVSF

SEQ ID NO: 66626 - protein, 32 aa, Homo sapiens
AKPALEDLRQGLLPVLESFKVSFLSALEEYTK

SEQ ID NO: 66627 - protein, 37 aa, Homo sapiens
AKPALEDLRQGLLPVLESFKVSFLSALEEYTKKLNTQ

SEQ ID NO: 66628 - protein, 12 aa, Homo sapiens
AKVQPYLDDFQK

SEQ ID NO: 66629 - protein, 13 aa, Homo sapiens
AKVQPYLDDFQKK

SEQ ID NO: 66630 - protein, 12 aa, Homo sapiens
ALEEYTKKLNTQ

SEQ ID NO: 66631 - protein, 9 aa, Homo sapiens
ARAHVDALR

SEQ ID NO: 66632 - protein, 20 aa, Homo sapiens
ARAHVDALRTHLAPYSDELR

SEQ ID NO: 66633 - protein, 13 aa, Homo sapiens
ARLEALKENGGAR

SEQ ID NO: 66634 - protein, 11 aa, Homo sapiens
ATEHLSTLSEK

SEQ ID NO: 66635 - protein, 13 aa, Homo sapiens
ATEHLSTLSEKAK

SEQ ID NO: 66636 - protein, 19 aa, Homo sapiens
ATEHLSTLSEKAKPALEDL

SEQ ID NO: 66637 - protein, 20 aa, Homo sapiens
ATEHLSTLSEKAKPALEDLR

SEQ ID NO: 66638 - protein, 31 aa, Homo sapiens
ATEHLSTLSEKAKPALEDLRQGLLPVLESFK

SEQ ID NO: 66639 - protein, 26 aa, Homo sapiens
ATVYVDVLKDSGRDYVSQFEGSALGK

SEQ ID NO: 66640 - protein, 15 aa, Homo sapiens
DALRTHLAPYSDELR

SEQ ID NO: 66641 - protein, 10 aa, Homo sapiens
DEPPQSPWDR

SEQ ID NO: 66642 - protein, 12 aa, Homo sapiens
DEPPQSPWDRVK

SEQ ID NO: 66643 - protein, 23 aa, Homo sapiens
DEPPQSPWDRVKDLATVYVDVLK

SEQ ID NO: 66644 - protein, 27 aa, Homo sapiens
DEPPQSPWDRVKDLATVYVDVLKDSGR

SEQ ID NO: 66645 - protein, 11 aa, Homo sapiens
DLATVYVDVLK

SEQ ID NO: 66646 - protein, 15 aa, Homo sapiens
DLATVYVDVLKDSGR

SEQ ID NO: 66647 - protein, 28 aa, Homo sapiens
DLATVYVDVLKDSGRDYVSQFEGSALGK

SEQ ID NO: 66648 - protein, 6 aa, Homo sapiens
DLEEVK

SEQ ID NO: 66649 - protein, 8 aa, Homo sapiens
DLEEVKAK

SEQ ID NO: 66650 - protein, 12 aa, Homo sapiens
DNWDSVTSTFSK

SEQ ID NO: 66651 - protein, 17 aa, Homo sapiens
DSGRDYVSQFEGSALGK

SEQ ID NO: 66652 - protein, 22 aa, Homo sapiens
DSGRDYVSQFEGSALGKQLNLK

SEQ ID NO: 66653 - protein, 8 aa, Homo sapiens
DYVSQFEG

SEQ ID NO: 66654 - protein, 9 aa, Homo sapiens
DYVSQFEGS

SEQ ID NO: 66655 - protein, 10 aa, Homo sapiens
DYVSQFEGSA

SEQ ID NO: 66656 - protein, 11 aa, Homo sapiens
DYVSQFEGSAL

SEQ ID NO: 66657 - protein, 12 aa, Homo sapiens
DYVSQFEGSALG

SEQ ID NO: 66658 - protein, 13 aa, Homo sapiens
DYVSQFEGSALGK

SEQ ID NO: 66659 - protein, 18 aa, Homo sapiens
DYVSQFEGSALGKQLNLK

SEQ ID NO: 66660 - protein, 10 aa, Homo sapiens
EQLGPVTQEF

SEQ ID NO: 66661 - protein, 12 aa, Homo sapiens
EQLGPVTQEFWD

SEQ ID NO: 66662 - protein, 13 aa, Homo sapiens
EQLGPVTQEFWDN

SEQ ID NO: 66663 - protein, 16 aa, Homo sapiens
EQLGPVTQEFWDNLEK

SEQ ID NO: 66664 - protein, 22 aa, Homo sapiens
EQLGPVTQEFWDNLEKETEGLR

SEQ ID NO: 66665 - protein, 27 aa, Homo sapiens
EQLGPVTQEFWDNLEKETEGLRQEMSK

SEQ ID NO: 66666 - protein, 6 aa, Homo sapiens
ETEGLR

SEQ ID NO: 66667 - protein, 11 aa, Homo sapiens
ETEGLRQEMSK

SEQ ID NO: 66668 - protein, 17 aa, Homo sapiens
ETEGLRQEMSKDLEEVK

SEQ ID NO: 66669 - protein, 19 aa, Homo sapiens
ETEGLRQEMSKDLEEVKAK

SEQ ID NO: 66670 - protein, 16 aa, Homo sapiens
EYHAKATEHLSTLSEK

SEQ ID NO: 66671 - protein, 13 aa, Homo sapiens
FEGSALGKQLNLK

SEQ ID NO: 66672 - protein, 10 aa, Homo sapiens
FLSALEEYTK

SEQ ID NO: 66673 - protein, 15 aa, Homo sapiens
FLSALEEYTKKLNTQ

SEQ ID NO: 66674 - protein, 10 aa, Homo sapiens
GLLPVLESFK

SEQ ID NO: 66675 - protein, 13 aa, Homo sapiens
GPVTQEFWDNLEK

SEQ ID NO: 66676 - protein, 19 aa, Homo sapiens
GPVTQEFWDNLEKETEGLR

SEQ ID NO: 66677 - protein, 15 aa, Homo sapiens
HFWQQDEPPQSPWDR

SEQ ID NO: 66678 - protein, 10 aa, Homo sapiens
HLAPYSDELR

SEQ ID NO: 66679 - protein, 8 aa, Homo sapiens
HLSTLSEK

SEQ ID NO: 66680 - protein, 19 aa, Homo sapiens
HVDALRTHLAPYSDELRQR

SEQ ID NO: 66681 - protein, 12 aa, Homo sapiens
KATEHLSTLSEK

SEQ ID NO: 66682 - protein, 12 aa, Homo sapiens
KDLATVYVDVLK

SEQ ID NO: 66683 - protein, 29 aa, Homo sapiens
KDLATVYVDVLKDSGRDYVSQFEGSALGK

SEQ ID NO: 66684 - protein, 18 aa, Homo sapiens
KDSGRDYVSQFEGSALGK

SEQ ID NO: 66685 - protein, 15 aa, Homo sapiens
KLLDNWDSVTSTFSK

SEQ ID NO: 66686 - protein, 14 aa, Homo sapiens
KVEPLRAELQEGAR

SEQ ID NO: 66687 - protein, 11 aa, Homo sapiens
KVQPYLDDFQK

SEQ ID NO: 66688 - protein, 13 aa, Homo sapiens
KVSFLSALEEYTK

SEQ ID NO: 66689 - protein, 10 aa, Homo sapiens
KWQEEMELYR

SEQ ID NO: 66690 - protein, 15 aa, Homo sapiens
LAARLEALKENGGAR

SEQ ID NO: 66691 - protein, 33 aa, Homo sapiens
LAARLEALKENGGARLAEYHAKATEHLSTLSEK

SEQ ID NO: 66692 - protein, 7 aa, Homo sapiens
LAEYHAK

SEQ ID NO: 66693 - protein, 15 aa, Homo sapiens
LAEYHAKATEHLSTL

SEQ ID NO: 66694 - protein, 18 aa, Homo sapiens
LAEYHAKATEHLSTLSEK

SEQ ID NO: 66695 - protein, 27 aa, Homo sapiens
LAEYHAKATEHLSTLSEKAKPALEDLR

SEQ ID NO: 66696 - protein, 10 aa, Homo sapiens
LATVYVDVLK

SEQ ID NO: 66697 - protein, 6 aa, Homo sapiens
LDDFQK

SEQ ID NO: 66698 - protein, 13 aa, Homo sapiens
LDNWDSVTSTFSK

SEQ ID NO: 66699 - protein, 11 aa, Homo sapiens
LEALKENGGAR

SEQ ID NO: 66700 - protein, 18 aa, Homo sapiens
LEALKENGGARLAEYHAK

SEQ ID NO: 66701 - protein, 29 aa, Homo sapiens
LEALKENGGARLAEYHAKATEHLSTLSEK

SEQ ID NO: 66702 - protein, 6 aa, Homo sapiens
LEEYTK

SEQ ID NO: 66703 - protein, 14 aa, Homo sapiens
LGPVTQEFWDNLEK

SEQ ID NO: 66704 - protein, 20 aa, Homo sapiens
LGPVTQEFWDNLEKETEGLR

SEQ ID NO: 66705 - protein, 7 aa, Homo sapiens
LHELQEK

SEQ ID NO: 66706 - protein, 16 aa, Homo sapiens
LHELQEKLSPLGEEMR

SEQ ID NO: 66707 - protein, 18 aa, Homo sapiens
LHELQEKLSPLGEEMRDR

SEQ ID NO: 66708 - protein, 16 aa, Homo sapiens
LKLLDNWDSVTSTFSK

SEQ ID NO: 66709 - protein, 11 aa, Homo sapiens
LLDNWDSVTST

SEQ ID NO: 66710 - protein, 12 aa, Homo sapiens
LLDNWDSVTSTF

SEQ ID NO: 66711 - protein, 14 aa, Homo sapiens
LLDNWDSVTSTFSK

SEQ ID NO: 66712 - protein, 16 aa, Homo sapiens
LLDNWDSVTSTFSKLR

SEQ ID NO: 66713 - protein, 8 aa, Homo sapiens
LPVLESFK

SEQ ID NO: 66714 - protein, 10 aa, Homo sapiens
LRAELQEGAR

SEQ ID NO: 66715 - protein, 12 aa, Homo sapiens
LREQLGPVTQEF

SEQ ID NO: 66716 - protein, 18 aa, Homo sapiens
LREQLGPVTQEFWDNLEK

SEQ ID NO: 66717 - protein, 24 aa, Homo sapiens
LREQLGPVTQEFWDNLEKETEGLR

SEQ ID NO: 66718 - protein, 27 aa, Homo sapiens
LREQLGPVTQEFWDNLEKETEGLRQEM

SEQ ID NO: 66719 - protein, 29 aa, Homo sapiens
LREQLGPVTQEFWDNLEKETEGLRQEMSK

SEQ ID NO: 66720 - protein, 35 aa, Homo sapiens
LREQLGPVTQEFWDNLEKETEGLRQEMSKDLEEVK

SEQ ID NO: 66721 - protein, 9 aa, Homo sapiens
LSALEEYTK

SEQ ID NO: 66722 - protein, 9 aa, Homo sapiens
LSPLGEEMR

SEQ ID NO: 66723 - protein, 11 aa, Homo sapiens
LSPLGEEMRDR

SEQ ID NO: 66724 - protein, 11 aa, Homo sapiens
NWDSVTSTFSK

SEQ ID NO: 66725 - protein, 7 aa, Homo sapiens
PALEDLR

SEQ ID NO: 66726 - protein, 18 aa, Homo sapiens
PALEDLRQGLLPVLESFK

SEQ ID NO: 66727 - protein, 7 aa, Homo sapiens
PLGEEMR

SEQ ID NO: 66728 - protein, 11 aa, Homo sapiens
PLRAELQEGAR

SEQ ID NO: 66729 - protein, 8 aa, Homo sapiens
PPQSPWDR

SEQ ID NO: 66730 - protein, 21 aa, Homo sapiens
PPQSPWDRVKDLATVYVDVLK

SEQ ID NO: 66731 - protein, 7 aa, Homo sapiens
PVLESFK

SEQ ID NO: 66732 - protein, 19 aa, Homo sapiens
PVLESFKVSFLSALEEYTK

SEQ ID NO: 66733 - protein, 12 aa, Homo sapiens
PVTQEFWDNLEK

SEQ ID NO: 66734 - protein, 18 aa, Homo sapiens
PVTQEFWDNLEKETEGLR

SEQ ID NO: 66735 - protein, 8 aa, Homo sapiens
PYLDDFQK

SEQ ID NO: 66736 - protein, 9 aa, Homo sapiens
PYLDDFQKK

SEQ ID NO: 66737 - protein, 18 aa, Homo sapiens
PYLDDFQKKWQEEMELYR

SEQ ID NO: 66738 - protein, 7 aa, Homo sapiens
PYSDELR

SEQ ID NO: 66739 - protein, 11 aa, Homo sapiens
QEMSKDLEEVK

SEQ ID NO: 66740 - protein, 13 aa, Homo sapiens
QEMSKDLEEVKAK

SEQ ID NO: 66741 - protein, 10 aa, Homo sapiens
QGLLPVLESF

SEQ ID NO: 66742 - protein, 11 aa, Homo sapiens
QGLLPVLESFK

SEQ ID NO: 66743 - protein, 14 aa, Homo sapiens
QGLLPVLESFKVSF

SEQ ID NO: 66744 - protein, 23 aa, Homo sapiens
QGLLPVLESFKVSFLSALEEYTK

SEQ ID NO: 66745 - protein, 24 aa, Homo sapiens
QGLLPVLESFKVSFLSALEEYTKK

SEQ ID NO: 66746 - protein, 28 aa, Homo sapiens
QGLLPVLESFKVSFLSALEEYTKKLNTQ

SEQ ID NO: 66747 - protein, 9 aa, Homo sapiens
QKLHELQEK

SEQ ID NO: 66748 - protein, 20 aa, Homo sapiens
QKLHELQEKLSPLGEEMRDR

SEQ ID NO: 66749 - protein, 7 aa, Homo sapiens
QKVEPLR

SEQ ID NO: 66750 - protein, 15 aa, Homo sapiens
QKVEPLRAELQEGAR

SEQ ID NO: 66751 - protein, 15 aa, Homo sapiens
QLGPVTQEFWDNLEK

SEQ ID NO: 66752 - protein, 19 aa, Homo sapiens
QLNLKLLDNWDSVTSTFSK

SEQ ID NO: 66753 - protein, 16 aa, Homo sapiens
RHFWQQDEPPQSPWDR

SEQ ID NO: 66754 - protein, 24 aa, Homo sapiens
RQGLLPVLESFKVSFLSALEEYTK

SEQ ID NO: 66755 - protein, 12 aa, Homo sapiens
RTHLAPYSDELR

SEQ ID NO: 66756 - protein, 8 aa, Homo sapiens
SALEEYTK

SEQ ID NO: 66757 - protein, 13 aa, Homo sapiens
SALEEYTKKLNTQ

SEQ ID NO: 66758 - protein, 15 aa, Homo sapiens
SFKVSFLSALEEYTK

SEQ ID NO: 66759 - protein, 16 aa, Homo sapiens
SFKVSFLSALEEYTKK

SEQ ID NO: 66760 - protein, 11 aa, Homo sapiens
SFLSALEEYTK

SEQ ID NO: 66761 - protein, 12 aa, Homo sapiens
SFLSALEEYTKK

SEQ ID NO: 66762 - protein, 16 aa, Homo sapiens
SFLSALEEYTKKLNTQ

SEQ ID NO: 66763 - protein, 8 aa, Homo sapiens
SPLGEEMR

SEQ ID NO: 66764 - protein, 10 aa, Homo sapiens
SQFEGSALGK

SEQ ID NO: 66765 - protein, 10 aa, Homo sapiens
TEHLSTLSEK

SEQ ID NO: 66766 - protein, 10 aa, Homo sapiens
THLAPYSDEL

SEQ ID NO: 66767 - protein, 11 aa, Homo sapiens
THLAPYSDELR

SEQ ID NO: 66768 - protein, 12 aa, Homo sapiens
THLAPYSDELRQ

SEQ ID NO: 66769 - protein, 13 aa, Homo sapiens
THLAPYSDELRQR

SEQ ID NO: 66770 - protein, 16 aa, Homo sapiens
TQEFWDNLEKETEGLR

SEQ ID NO: 66771 - protein, 16 aa, Homo sapiens
VDALRTHLAPYSDELR

SEQ ID NO: 66772 - protein, 22 aa, Homo sapiens
VDVLKDSGRDYVSQFEGSALGK

SEQ ID NO: 66773 - protein, 13 aa, Homo sapiens
VEPLRAELQEGAR

SEQ ID NO: 66774 - protein, 13 aa, Homo sapiens
VKDLATVYVDVLK

SEQ ID NO: 66775 - protein, 17 aa, Homo sapiens
VKDLATVYVDVLKDSGR

SEQ ID NO: 66776 - protein, 18 aa, Homo sapiens
VKDLATVYVDVLKDSGRD

SEQ ID NO: 66777 - protein, 30 aa, Homo sapiens
VKDLATVYVDVLKDSGRDYVSQFEGSALGK

SEQ ID NO: 66778 - protein, 35 aa, Homo sapiens
VKDLATVYVDVLKDSGRDYVSQFEGSALGKQLNLK

SEQ ID NO: 66779 - protein, 6 aa, Homo sapiens
VLESFK

SEQ ID NO: 66780 - protein, 10 aa, Homo sapiens
VQPYLDDFQK

SEQ ID NO: 66781 - protein, 11 aa, Homo sapiens
VQPYLDDFQKK

SEQ ID NO: 66782 - protein, 20 aa, Homo sapiens
VQPYLDDFQKKWQEEMELYR

SEQ ID NO: 66783 - protein, 10 aa, Homo sapiens
VSFLSALEEY

SEQ ID NO: 66784 - protein, 11 aa, Homo sapiens
VSFLSALEEYT

SEQ ID NO: 66785 - protein, 12 aa, Homo sapiens
VSFLSALEEYTK

SEQ ID NO: 66786 - protein, 13 aa, Homo sapiens
VSFLSALEEYTKK

SEQ ID NO: 66787 - protein, 16 aa, Homo sapiens
VSFLSALEEYTKKLNT

SEQ ID NO: 66788 - protein, 17 aa, Homo sapiens
VSFLSALEEYTKKLNTQ

SEQ ID NO: 66789 - protein, 11 aa, Homo sapiens
VSQFEGSALGK

SEQ ID NO: 66790 - protein, 10 aa, Homo sapiens
WDSVTSTFSK

SEQ ID NO: 66791 - protein, 9 aa, Homo sapiens
WQEEMELYR

SEQ ID NO: 66792 - protein, 11 aa, Homo sapiens
WQEEMELYRQK

SEQ ID NO: 66793 - protein, 13 aa, Homo sapiens
WQQDEPPQSPWDR

SEQ ID NO: 66794 - protein, 23 aa, Homo sapiens
YVDVLKDSGRDYVSQFEGSALGK

SEQ ID NO: 66795 - protein, 12 aa, Homo sapiens
YVSQFEGSALGK

SEQ ID NO: 66796 - protein, 11 aa, Homo sapiens
AGTELVNFLSY

SEQ ID NO: 66797 - protein, 12 aa, Homo sapiens
AGTELVNFLSYF

SEQ ID NO: 66798 - protein, 14 aa, Homo sapiens
AGTELVNFLSYFVE

SEQ ID NO: 66799 - protein, 20 aa, Homo sapiens
AGTELVNFLSYFVELGTQPA

SEQ ID NO: 66800 - protein, 21 aa, Homo sapiens
AGTELVNFLSYFVELGTQPAT

SEQ ID NO: 66801 - protein, 22 aa, Homo sapiens
AGTELVNFLSYFVELGTQPATQ

SEQ ID NO: 66802 - protein, 22 aa, Homo sapiens
AKEPCVESLVSQYFQTVTDYGK

SEQ ID NO: 66803 - protein, 18 aa, Homo sapiens
CVESLVSQYFQTVTDYGK

SEQ ID NO: 66804 - protein, 23 aa, Homo sapiens
CVESLVSQYFQTVTDYGKDLMEK

SEQ ID NO: 66805 - protein, 16 aa, Homo sapiens
DLMEKVKSPELQAEAK

SEQ ID NO: 66806 - protein, 21 aa, Homo sapiens
DLMEKVKSPELQAEAKSYFEK

SEQ ID NO: 66807 - protein, 19 aa, Homo sapiens
EPCVESLVSQYFQTVTDYG

SEQ ID NO: 66808 - protein, 20 aa, Homo sapiens
EPCVESLVSQYFQTVTDYGK

SEQ ID NO: 66809 - protein, 25 aa, Homo sapiens
EPCVESLVSQYFQTVTDYGKDLMEK

SEQ ID NO: 66810 - protein, 8 aa, Homo sapiens
EQLTPLIK

SEQ ID NO: 66811 - protein, 9 aa, Homo sapiens
EQLTPLIKK

SEQ ID NO: 66812 - protein, 16 aa, Homo sapiens
ESLVSQYFQTVTDYGK

SEQ ID NO: 66813 - protein, 15 aa, Homo sapiens
FLSYFVELGTQPATQ

SEQ ID NO: 66814 - protein, 9 aa, Homo sapiens
FQTVTDYGK

SEQ ID NO: 66815 - protein, 14 aa, Homo sapiens
FQTVTDYGKDLMEK

SEQ ID NO: 66816 - protein, 11 aa, Homo sapiens
FVELGTQPATQ

SEQ ID NO: 66817 - protein, 21 aa, Homo sapiens
GTELVNFLSYFVELGTQPATQ

SEQ ID NO: 66818 - protein, 12 aa, Homo sapiens
KAGTELVNFLSY

SEQ ID NO: 66819 - protein, 15 aa, Homo sapiens
KAGTELVNFLSYFVE

SEQ ID NO: 66820 - protein, 21 aa, Homo sapiens
KAGTELVNFLSYFVELGTQPA

SEQ ID NO: 66821 - protein, 22 aa, Homo sapiens
KAGTELVNFLSYFVELGTQPAT

SEQ ID NO: 66822 - protein, 23 aa, Homo sapiens
KAGTELVNFLSYFVELGTQPATQ

SEQ ID NO: 66823 - protein, 21 aa, Homo sapiens
KEPCVESLVSQYFQTVTDYGK

SEQ ID NO: 66824 - protein, 26 aa, Homo sapiens
KEPCVESLVSQYFQTVTDYGKDLMEK

SEQ ID NO: 66825 - protein, 14 aa, Homo sapiens
LSYFVELGTQPATQ

SEQ ID NO: 66826 - protein, 14 aa, Homo sapiens
LVSQYFQTVTDYGK

SEQ ID NO: 66827 - protein, 23 aa, Homo sapiens
MKLLAATVLLLTICSLEGALVRR

SEQ ID NO: 66828 - protein, 19 aa, Homo sapiens
PCVESLVSQYFQTVTDYGK

SEQ ID NO: 66829 - protein, 8 aa, Homo sapiens
PELQAEAK

SEQ ID NO: 66830 - protein, 23 aa, Homo sapiens
QAKEPCVESLVSQYFQTVTDYGK

SEQ ID NO: 66831 - protein, 24 aa, Homo sapiens
RQAKEPCVESLVSQYFQTVTDYGK

SEQ ID NO: 66832 - protein, 10 aa, Homo sapiens
SKEQLTPLIK

SEQ ID NO: 66833 - protein, 11 aa, Homo sapiens
SKEQLTPLIKK

SEQ ID NO: 66834 - protein, 15 aa, Homo sapiens
SLVSQYFQTVTDYGK

SEQ ID NO: 66835 - protein, 9 aa, Homo sapiens
SPELQAEAK

SEQ ID NO: 66836 - protein, 14 aa, Homo sapiens
SPELQAEAKSYFEK

SEQ ID NO: 66837 - protein, 25 aa, Homo sapiens
SPELQAEAKSYFEKSKEQLTPLIKK

SEQ ID NO: 66838 - protein, 12 aa, Homo sapiens
SQYFQTVTDYGK

SEQ ID NO: 66839 - protein, 13 aa, Homo sapiens
SYFEKSKEQLTPL

SEQ ID NO: 66840 - protein, 15 aa, Homo sapiens
SYFEKSKEQLTPLIK

SEQ ID NO: 66841 - protein, 16 aa, Homo sapiens
SYFEKSKEQLTPLIKK

SEQ ID NO: 66842 - protein, 13 aa, Homo sapiens
SYFVELGTQPATQ

SEQ ID NO: 66843 - protein, 17 aa, Homo sapiens
VESLVSQYFQTVTDYGK

SEQ ID NO: 66844 - protein, 11 aa, Homo sapiens
VKSPELQAEAK

SEQ ID NO: 66845 - protein, 16 aa, Homo sapiens
VKSPELQAEAKSYFEK

SEQ ID NO: 66846 - protein, 26 aa, Homo sapiens
VKSPELQAEAKSYFEKSKEQLTPLIK

SEQ ID NO: 66847 - protein, 27 aa, Homo sapiens
VKSPELQAEAKSYFEKSKEQLTPLIKK

SEQ ID NO: 66848 - protein, 13 aa, Homo sapiens
VSQYFQTVTDYGK

SEQ ID NO: 66849 - protein, 10 aa, Homo sapiens
YFQTVTDYGK

SEQ ID NO: 66850 - protein, 15 aa, Homo sapiens
YFQTVTDYGKDLMEK

SEQ ID NO: 66851 - protein, 12 aa, Homo sapiens
YFVELGTQPATQ

SEQ ID NO: 66852 - protein, 20 aa, Homo sapiens
AQLLGGVDEAWALLQGLQSR

SEQ ID NO: 66853 - protein, 12 aa, Homo sapiens
DSLEQDLNNMNK

SEQ ID NO: 66854 - protein, 16 aa, Homo sapiens
ELFHPYAESLVSGIGR

SEQ ID NO: 66855 - protein, 14 aa, Homo sapiens
SAFAPEFQQTDSGK

SEQ ID NO: 66856 - protein, 12 aa, Homo sapiens
SVAPHAPASPAR

SEQ ID NO: 66857 - protein, 18 aa, Homo sapiens
AMSTYTGIFTDQVLSVLK

SEQ ID NO: 66858 - protein, 13 aa, Homo sapiens
DEMPSPTFLTQVK

SEQ ID NO: 66859 - protein, 26 aa, Homo sapiens
DLYSKSTAAMSTYTGIFTDQVLSVLK

SEQ ID NO: 66860 - protein, 11 aa, Homo sapiens
ESLSSYWESAK

SEQ ID NO: 66861 - protein, 20 aa, Homo sapiens
ESLSSYWESAKTAAQNLYEK

SEQ ID NO: 66862 - protein, 10 aa, Homo sapiens
FTDQVLSVLK

SEQ ID NO: 66863 - protein, 13 aa, Homo sapiens
FTDQVLSVLKGEE

SEQ ID NO: 66864 - protein, 20 aa, Homo sapiens
GTQQPQQDEMPSPTFLTQVK

SEQ ID NO: 66865 - protein, 11 aa, Homo sapiens
IFTDQVLSVLK

SEQ ID NO: 66866 - protein, 14 aa, Homo sapiens
IFTDQVLSVLKGEE

SEQ ID NO: 66867 - protein, 7 aa, Homo sapiens
LPAVDEK

SEQ ID NO: 66868 - protein, 7 aa, Homo sapiens
LRDLYSK

SEQ ID NO: 66869 - protein, 17 aa, Homo sapiens
MSTYTGIFTDQVLSVLK

SEQ ID NO: 66870 - protein, 8 aa, Homo sapiens
PAVDEKLR

SEQ ID NO: 66871 - protein, 13 aa, Homo sapiens
PAVDEKLRDLYSK

SEQ ID NO: 66872 - protein, 16 aa, Homo sapiens
PQQDEMPSPTFLTQVK

SEQ ID NO: 66873 - protein, 10 aa, Homo sapiens
PSPTFLTQVK

SEQ ID NO: 66874 - protein, 21 aa, Homo sapiens
PSPTFLTQVKESLSSYWESAK

SEQ ID NO: 66875 - protein, 8 aa, Homo sapiens
PTFLTQVK

SEQ ID NO: 66876 - protein, 21 aa, Homo sapiens
STAAMSTYTGIFTDQVLSVLK

SEQ ID NO: 66877 - protein, 24 aa, Homo sapiens
STAAMSTYTGIFTDQVLSVLKGEE

SEQ ID NO: 66878 - protein, 16 aa, Homo sapiens
STYTGIFTDQVLSVLK

SEQ ID NO: 66879 - protein, 7 aa, Homo sapiens
SYWESAK

SEQ ID NO: 66880 - protein, 9 aa, Homo sapiens
TAAQNLYEK

SEQ ID NO: 66881 - protein, 18 aa, Homo sapiens
TAAQNLYEKTYLPAVDEK

SEQ ID NO: 66882 - protein, 25 aa, Homo sapiens
TAAQNLYEKTYLPAVDEKLRDLYSK

SEQ ID NO: 66883 - protein, 13 aa, Homo sapiens
TGIFTDQVLSVLK

SEQ ID NO: 66884 - protein, 16 aa, Homo sapiens
TGIFTDQVLSVLKGEE

SEQ ID NO: 66885 - protein, 19 aa, Homo sapiens
TQQPQQDEMPSPTFLTQVK

SEQ ID NO: 66886 - protein, 30 aa, Homo sapiens
TQQPQQDEMPSPTFLTQVKESLSSYWESAK

SEQ ID NO: 66887 - protein, 9 aa, Homo sapiens
TYLPAVDEK

SEQ ID NO: 66888 - protein, 11 aa, Homo sapiens
TYLPAVDEKLR

SEQ ID NO: 66889 - protein, 16 aa, Homo sapiens
TYLPAVDEKLRDLYSK

SEQ ID NO: 66890 - protein, 15 aa, Homo sapiens
TYTGIFTDQVLSVLK

SEQ ID NO: 66891 - protein, 14 aa, Homo sapiens
YTGIFTDQVLSVLK

SEQ ID NO: 66892 - protein, 11 aa, Homo sapiens
AISAALKPALR

SEQ ID NO: 66893 - protein, 15 aa, Homo sapiens
DANISQPETTKEGLR

SEQ ID NO: 66894 - protein, 35 aa, Homo sapiens
DGAIDLGYDLLMTMAGMSGGPMGLAISAALKPALR

SEQ ID NO: 66895 - protein, 18 aa, Homo sapiens
EQAVHNVVQLLPGVGTFY

SEQ ID NO: 66896 - protein, 22 aa, Homo sapiens
EQAVHNVVQLLPGVGTFYNLGT

SEQ ID NO: 66897 - protein, 25 aa, Homo sapiens
EQAVHNVVQLLPGVGTFYNLGTALY

SEQ ID NO: 66898 - protein, 26 aa, Homo sapiens
EQAVHNVVQLLPGVGTFYNLGTALYY

SEQ ID NO: 66899 - protein, 30 aa, Homo sapiens
EQAVHNVVQLLPGVGTFYNLGTALYYATQN

SEQ ID NO: 66900 - protein, 34 aa, Homo sapiens
EQAVHNVVQLLPGVGTFYNLGTALYYATQNCLGK

SEQ ID NO: 66901 - protein, 13 aa, Homo sapiens
GLAISAALKPALR

SEQ ID NO: 66902 - protein, 17 aa, Homo sapiens
KDANISQPETTKEGLRA

SEQ ID NO: 66903 - protein, 17 aa, Homo sapiens
RQGGVNATQVLIQHLRG

SEQ ID NO: 66904 - protein, 22 aa, Homo sapiens
RSTERNVSVEALASALQLLARE

SEQ ID NO: 66905 - protein, 18 aa, Homo sapiens
SGGPMGLAISAALKPALR

SEQ ID NO: 66906 - protein, 14 aa, Homo sapiens
SGVQQLIQYYQDQK

SEQ ID NO: 66907 - protein, 11 aa, Homo sapiens
SLPTEDCENEK

SEQ ID NO: 66908 - protein, 20 aa, Homo sapiens
STERNVSVEALASALQLLAR

SEQ ID NO: 66909 - protein, 13 aa, Homo sapiens
SYDLDPGAGSLEI

SEQ ID NO: 66910 - protein, 10 aa, Homo sapiens
AGILENGAVR

SEQ ID NO: 66911 - protein, 18 aa, Homo sapiens
AMFGNDTITCTTHGNWTK

SEQ ID NO: 66912 - protein, 21 aa, Homo sapiens
ATFGCHDGYSLDGPEEIECTK

SEQ ID NO: 66913 - protein, 32 aa, Homo sapiens
ATFGCHDGYSLDGPEEIECTKLGNWSAMPSCK

SEQ ID NO: 66914 - protein, 9 aa, Homo sapiens
ATVVYQGER

SEQ ID NO: 66915 - protein, 11 aa, Homo sapiens
ATVVYQGERVK

SEQ ID NO: 66916 - protein, 15 aa, Homo sapiens
ATVVYQGERVKIQEK

SEQ ID NO: 66917 - protein, 17 aa, Homo sapiens
ATVVYQGERVKIQEKFK

SEQ ID NO: 66918 - protein, 27 aa, Homo sapiens
AVFECLPQHAMFGNDTITCTTHGNWTK

SEQ ID NO: 66919 - protein, 12 aa, Homo sapiens
CFKEHSSLAFWK

SEQ ID NO: 66920 - protein, 23 aa, Homo sapiens
CLPQHAMFGNDTITCTTHGNWTK

SEQ ID NO: 66921 - protein, 28 aa, Homo sapiens
CLPQHAMFGNDTITCTTHGNWTKLPECR

SEQ ID NO: 66922 - protein, 17 aa, Homo sapiens
CPFPSRPDNGFVNYPAK

SEQ ID NO: 66923 - protein, 21 aa, Homo sapiens
CPFPSRPDNGFVNYPAKPTLY

SEQ ID NO: 66924 - protein, 23 aa, Homo sapiens
CPFPSRPDNGFVNYPAKPTLYYK

SEQ ID NO: 66925 - protein, 25 aa, Homo sapiens
CPFPSRPDNGFVNYPAKPTLYYKDK

SEQ ID NO: 66926 - protein, 13 aa, Homo sapiens
CPLTGLWPINTLK

SEQ ID NO: 66927 - protein, 18 aa, Homo sapiens
CSYTEDAQCIDGTIEVPK

SEQ ID NO: 66928 - protein, 31 aa, Homo sapiens
CTEEGKWSPELPVCAPIICPPPSIPTFATLR

SEQ ID NO: 66929 - protein, 23 aa, Homo sapiens
DKATFGCHDGYSLDGPEEIECTK

SEQ ID NO: 66930 - protein, 16 aa, Homo sapiens
DTAVFECLPQHAMFGN

SEQ ID NO: 66931 - protein, 17 aa, Homo sapiens
DTAVFECLPQHAMFGND

SEQ ID NO: 66932 - protein, 20 aa, Homo sapiens
DTAVFECLPQHAMFGNDTIT

SEQ ID NO: 66933 - protein, 26 aa, Homo sapiens
DTAVFECLPQHAMFGNDTITCTTHGN

SEQ ID NO: 66934 - protein, 29 aa, Homo sapiens
DTAVFECLPQHAMFGNDTITCTTHGNWTK

SEQ ID NO: 66935 - protein, 34 aa, Homo sapiens
DTAVFECLPQHAMFGNDTITCTTHGNWTKLPECR

SEQ ID NO: 66936 - protein, 13 aa, Homo sapiens
DTITCTTHGNWTK

SEQ ID NO: 66937 - protein, 18 aa, Homo sapiens
DTITCTTHGNWTKLPECR

SEQ ID NO: 66938 - protein, 24 aa, Homo sapiens
ECLPQHAMFGNDTITCTTHGNWTK

SEQ ID NO: 66939 - protein, 29 aa, Homo sapiens
ECLPQHAMFGNDTITCTTHGNWTKLPECR

SEQ ID NO: 66940 - protein, 9 aa, Homo sapiens
EHSSLAFWK

SEQ ID NO: 66941 - protein, 18 aa, Homo sapiens
EHSSLAFWKTDASDVKPC

SEQ ID NO: 66942 - protein, 17 aa, Homo sapiens
EPGEEITYSCKPGYVSR

SEQ ID NO: 66943 - protein, 24 aa, Homo sapiens
EVKCPFPSRPDNGFVNYPAKPTLY

SEQ ID NO: 66944 - protein, 26 aa, Homo sapiens
EVKCPFPSRPDNGFVNYPAKPTLYYK

SEQ ID NO: 66945 - protein, 7 aa, Homo sapiens
FCKNKEK

SEQ ID NO: 66946 - protein, 25 aa, Homo sapiens
FECLPQHAMFGNDTITCTTHGNWTK

SEQ ID NO: 66947 - protein, 30 aa, Homo sapiens
FECLPQHAMFGNDTITCTTHGNWTKLPECR

SEQ ID NO: 66948 - protein, 16 aa, Homo sapiens
FGNDTITCTTHGNWTK

SEQ ID NO: 66949 - protein, 15 aa, Homo sapiens
FICPLTGLWPINTLK

SEQ ID NO: 66950 - protein, 10 aa, Homo sapiens
FKNGMLHGDK

SEQ ID NO: 66951 - protein, 16 aa, Homo sapiens
FKNGMLHGDKVSFFCK

SEQ ID NO: 66952 - protein, 21 aa, Homo sapiens
FPSRPDNGFVNYPAKPTLYYK

SEQ ID NO: 66953 - protein, 13 aa, Homo sapiens
FVNYPAKPTLYYK

SEQ ID NO: 66954 - protein, 14 aa, Homo sapiens
GFVNYPAKPTLYYK

SEQ ID NO: 66955 - protein, 9 aa, Homo sapiens
GPEEIECTK

SEQ ID NO: 66956 - protein, 20 aa, Homo sapiens
GPEEIECTKLGNWSAMPSCK

SEQ ID NO: 66957 - protein, 19 aa, Homo sapiens
GRTCPKPDDLPFSTVVPLK

SEQ ID NO: 66958 - protein, 14 aa, Homo sapiens
GYSLDGPEEIECTK

SEQ ID NO: 66959 - protein, 20 aa, Homo sapiens
IQEKFKNGMLHGDKVSFFCK

SEQ ID NO: 66960 - protein, 10 aa, Homo sapiens
KATVVYQGER

SEQ ID NO: 66961 - protein, 12 aa, Homo sapiens
KATVVYQGERVK

SEQ ID NO: 66962 - protein, 16 aa, Homo sapiens
KATVVYQGERVKIQEK

SEQ ID NO: 66963 - protein, 19 aa, Homo sapiens
KCSYTEDAQCIDGTIEVPK

SEQ ID NO: 66964 - protein, 16 aa, Homo sapiens
KFICPLTGLWPINTLK

SEQ ID NO: 66965 - protein, 13 aa, Homo sapiens
KLGNWSAMPSCKA

SEQ ID NO: 66966 - protein, 11 aa, Homo sapiens
KPSAGNNSLYR

SEQ ID NO: 66967 - protein, 11 aa, Homo sapiens
LGNWSAMPSCK

SEQ ID NO: 66968 - protein, 15 aa, Homo sapiens
LGNWSAMPSCKASCK

SEQ ID NO: 66969 - protein, 10 aa, Homo sapiens
LPFSTVVPLK

SEQ ID NO: 66970 - protein, 19 aa, Homo sapiens
NDTITCTTHGNWTKLPECR

SEQ ID NO: 66971 - protein, 8 aa, Homo sapiens
NGMLHGDK

SEQ ID NO: 66972 - protein, 14 aa, Homo sapiens
NGMLHGDKVSFFCK

SEQ ID NO: 66973 - protein, 13 aa, Homo sapiens
NTGFYLNGADSAK

SEQ ID NO: 66974 - protein, 13 aa, Homo sapiens
PDDLPFSTVVPLK

SEQ ID NO: 66975 - protein, 11 aa, Homo sapiens
PDNGFVNYPAK

SEQ ID NO: 66976 - protein, 19 aa, Homo sapiens
PDNGFVNYPAKPTLYYKDK

SEQ ID NO: 66977 - protein, 12 aa, Homo sapiens
PFAGILENGAVR

SEQ ID NO: 66978 - protein, 9 aa, Homo sapiens
PFSTVVPLK

SEQ ID NO: 66979 - protein, 16 aa, Homo sapiens
PGEEITYSCKPGYVSR

SEQ ID NO: 66980 - protein, 16 aa, Homo sapiens
PIICPPPSIPTFATLR

SEQ ID NO: 66981 - protein, 15 aa, Homo sapiens
PKPDDLPFSTVVPLK

SEQ ID NO: 66982 - protein, 12 aa, Homo sapiens
PLTGLWPINTLK

SEQ ID NO: 66983 - protein, 12 aa, Homo sapiens
PPPSIPTFATLR

SEQ ID NO: 66984 - protein, 21 aa, Homo sapiens
PQHAMFGNDTITCTTHGNWTK

SEQ ID NO: 66985 - protein, 26 aa, Homo sapiens
PQHAMFGNDTITCTTHGNWTKLPECR

SEQ ID NO: 66986 - protein, 10 aa, Homo sapiens
PSAGNNSLYR

SEQ ID NO: 66987 - protein, 20 aa, Homo sapiens
PSRPDNGFVNYPAKPTLYYK

SEQ ID NO: 66988 - protein, 6 aa, Homo sapiens
PTLYYK

SEQ ID NO: 66989 - protein, 20 aa, Homo sapiens
PVCAPIICPPPSIPTFATLR

SEQ ID NO: 66990 - protein, 31 aa, Homo sapiens
RDTAVFECLPQHAMFGNDTITCTTHGNWTKL

SEQ ID NO: 66991 - protein, 14 aa, Homo sapiens
RVYKPSAGNNSLYR

SEQ ID NO: 66992 - protein, 15 aa, Homo sapiens
RVYKPSAGNNSLYRD

SEQ ID NO: 66993 - protein, 15 aa, Homo sapiens
SCNTGFYLNGADSAK

SEQ ID NO: 66994 - protein, 19 aa, Homo sapiens
SFSCNTGFYLNGADSAKCT

SEQ ID NO: 66995 - protein, 19 aa, Homo sapiens
SRPDNGFVNYPAKPTLYYK

SEQ ID NO: 66996 - protein, 7 aa, Homo sapiens
SSLAFWK

SEQ ID NO: 66997 - protein, 28 aa, Homo sapiens
TAVFECLPQHAMFGNDTITCTTHGNWTK

SEQ ID NO: 66998 - protein, 17 aa, Homo sapiens
TCPKPDDLPFSTVVPLK

SEQ ID NO: 66999 - protein, 10 aa, Homo sapiens
TCTTHGNWTK

SEQ ID NO: 67000 - protein, 9 aa, Homo sapiens
TDASDVKPC

SEQ ID NO: 67001 - protein, 20 aa, Homo sapiens
TFGCHDGYSLDGPEEIECTK

SEQ ID NO: 67002 - protein, 11 aa, Homo sapiens
TFYEPGEEITY

SEQ ID NO: 67003 - protein, 12 aa, Homo sapiens
TFYEPGEEITYS

SEQ ID NO: 67004 - protein, 14 aa, Homo sapiens
TFYEPGEEITYSCK

SEQ ID NO: 67005 - protein, 20 aa, Homo sapiens
TFYEPGEEITYSCKPGYVSR

SEQ ID NO: 67006 - protein, 12 aa, Homo sapiens
TGFYLNGADSAK

SEQ ID NO: 67007 - protein, 10 aa, Homo sapiens
TGLWPINTLK

SEQ ID NO: 67008 - protein, 12 aa, Homo sapiens
TITCTTHGNWTK

SEQ ID NO: 67009 - protein, 17 aa, Homo sapiens
TITCTTHGNWTKLPECR

SEQ ID NO: 67010 - protein, 14 aa, Homo sapiens
VCPFAGILENGAVR

SEQ ID NO: 67011 - protein, 26 aa, Homo sapiens
VFECLPQHAMFGNDTITCTTHGNWTK

SEQ ID NO: 67012 - protein, 31 aa, Homo sapiens
VFECLPQHAMFGNDTITCTTHGNWTKLPECR

SEQ ID NO: 67013 - protein, 6 aa, Homo sapiens
VKIQEK

SEQ ID NO: 67014 - protein, 22 aa, Homo sapiens
VKIQEKFKNGMLHGDKVSFFCK

SEQ ID NO: 67015 - protein, 6 aa, Homo sapiens
VSFFCK

SEQ ID NO: 67016 - protein, 13 aa, Homo sapiens
VYKPSAGNNSLYR

SEQ ID NO: 67017 - protein, 11 aa, Homo sapiens
WKTDASDVKPC

SEQ ID NO: 67018 - protein, 25 aa, Homo sapiens
WSPELPVCAPIICPPPSIPTFATLR

SEQ ID NO: 67019 - protein, 8 aa, Homo sapiens
WTKLPECR

SEQ ID NO: 67020 - protein, 18 aa, Homo sapiens
YEPGEEITYSCKPGYVSR

SEQ ID NO: 67021 - protein, 12 aa, Homo sapiens
YKPSAGNNSLYR

SEQ ID NO: 67022 - protein, 10 aa, Homo sapiens
YPAKPTLYYK

SEQ ID NO: 67023 - protein, 12 aa, Homo sapiens
YTTFEYPNTISF

SEQ ID NO: 67024 - protein, 27 aa, Homo sapiens
YTTFEYPNTISFSCNTGFYLNGADSAK

SEQ ID NO: 67025 - protein, 7 aa, Homo sapiens
AFLLTPR

SEQ ID NO: 67026 - protein, 6 aa, Homo sapiens
CVEEFK

SEQ ID NO: 67027 - protein, 7 aa, Homo sapiens
DGLCVPR

SEQ ID NO: 67028 - protein, 14 aa, Homo sapiens
EELATFDPVDNIVF

SEQ ID NO: 67029 - protein, 15 aa, Homo sapiens
EELATFDPVDNIVFN

SEQ ID NO: 67030 - protein, 23 aa, Homo sapiens
EELATFDPVDNIVFNMAAGSAPM

SEQ ID NO: 67031 - protein, 28 aa, Homo sapiens
EELATFDPVDNIVFNMAAGSAPMQLHLR

SEQ ID NO: 67032 - protein, 11 aa, Homo sapiens
EFPEVHLGQWY

SEQ ID NO: 67033 - protein, 12 aa, Homo sapiens
EFPEVHLGQWYF

SEQ ID NO: 67034 - protein, 20 aa, Homo sapiens
EFPEVHLGQWYFIAGAAPTK

SEQ ID NO: 67035 - protein, 9 aa, Homo sapiens
FIAGAAPTK

SEQ ID NO: 67036 - protein, 6 aa, Homo sapiens
FLLYNR

SEQ ID NO: 67037 - protein, 13 aa, Homo sapiens
FLLYNRSPHPPEK

SEQ ID NO: 67038 - protein, 10 aa, Homo sapiens
HLTEGSTDLR

SEQ ID NO: 67039 - protein, 12 aa, Homo sapiens
HSQLTTLGVDGK

SEQ ID NO: 67040 - protein, 12 aa, Homo sapiens
IYHLTEGSTDLR

SEQ ID NO: 67041 - protein, 25 aa, Homo sapiens
KTELFSSSCPGGIMLNETGQGYQRF

SEQ ID NO: 67042 - protein, 14 aa, Homo sapiens
KWIYHLTEGSTDLR

SEQ ID NO: 67043 - protein, 22 aa, Homo sapiens
KWIYHLTEGSTDLRTEGRPDMK

SEQ ID NO: 67044 - protein, 14 aa, Homo sapiens
LGQWYFIAGAAPTK

SEQ ID NO: 67045 - protein, 9 aa, Homo sapiens
MKDGLCVPR

SEQ ID NO: 67046 - protein, 10 aa, Homo sapiens
NQEACELSNN

SEQ ID NO: 67047 - protein, 15 aa, Homo sapiens
PGGIMLNETGQGYQR

SEQ ID NO: 67048 - protein, 21 aa, Homo sapiens
PVDNIVFNMAAGSAPMQLHLR

SEQ ID NO: 67049 - protein, 8 aa, Homo sapiens
RFLLYNRS

SEQ ID NO: 67050 - protein, 9 aa, Homo sapiens
SLTSCLDSK

SEQ ID NO: 67051 - protein, 11 aa, Homo sapiens
SQLTTLGVDGK

SEQ ID NO: 67052 - protein, 18 aa, Homo sapiens
SSCPGGIMLNETGQGYQR

SEQ ID NO: 67053 - protein, 19 aa, Homo sapiens
SSSCPGGIMLNETGQGYQR

SEQ ID NO: 67054 - protein, 8 aa, Homo sapiens
TEGRPDMK

SEQ ID NO: 67055 - protein, 31 aa, Homo sapiens
TEGRPDMKTELFSSSCPGGIMLNETGQGYQR

SEQ ID NO: 67056 - protein, 23 aa, Homo sapiens
TELFSSSCPGGIMLNETGQGYQR

SEQ ID NO: 67057 - protein, 13 aa, Homo sapiens
WIYHLTEGSTDLR

SEQ ID NO: 67058 - protein, 11 aa, Homo sapiens
ADHDALLFHLK

SEQ ID NO: 67059 - protein, 11 aa, Homo sapiens
GPPPAQPLAQR

SEQ ID NO: 67060 - protein, 29 aa, Homo sapiens
KEAFSNFSSSTLTEVQAISTHGGSVGDKI

SEQ ID NO: 67061 - protein, 18 aa, Homo sapiens
RFVACQMELLHSNGSQRT

SEQ ID NO: 67062 - protein, 7 aa, Homo sapiens
AEEILSR

SEQ ID NO: 67063 - protein, 8 aa, Homo sapiens
AILQSGSF

SEQ ID NO: 67064 - protein, 21 aa, Homo sapiens
AILQSGSFNAPWAVTSLYEAR

SEQ ID NO: 67065 - protein, 12 aa, Homo sapiens
APWAVTSLYEAR

SEQ ID NO: 67066 - protein, 14 aa, Homo sapiens
DEGTAFLVYGAPGF

SEQ ID NO: 67067 - protein, 16 aa, Homo sapiens
DEGTAFLVYGAPGFSK

SEQ ID NO: 67068 - protein, 12 aa, Homo sapiens
DNYTKAEEILSR

SEQ ID NO: 67069 - protein, 21 aa, Homo sapiens
EALGDVVGDYNFICPALEFTK

SEQ ID NO: 67070 - protein, 22 aa, Homo sapiens
EALGDVVGDYNFICPALEFTKK

SEQ ID NO: 67071 - protein, 9 aa, Homo sapiens
EDDIIIATK

SEQ ID NO: 67072 - protein, 7 aa, Homo sapiens
EFQEGLK

SEQ ID NO: 67073 - protein, 12 aa, Homo sapiens
EIEFVFGLPLER

SEQ ID NO: 67074 - protein, 20 aa, Homo sapiens
ESILFHYTDWVDDQRPENYR

SEQ ID NO: 67075 - protein, 24 aa, Homo sapiens
FGPTVDGDFLTDMPDILLELGQFK

SEQ ID NO: 67076 - protein, 9 aa, Homo sapiens
FKKPQSLTK

SEQ ID NO: 67077 - protein, 9 aa, Homo sapiens
FSEWGNNAF

SEQ ID NO: 67078 - protein, 16 aa, Homo sapiens
FSEWGNNAFFYYFEHR

SEQ ID NO: 67079 - protein, 8 aa, Homo sapiens
FWTSFFPK

SEQ ID NO: 67080 - protein, 17 aa, Homo sapiens
GGGFQTGTSSLHVYDGK

SEQ ID NO: 67081 - protein, 26 aa, Homo sapiens
GMNLTVFGGTVTAFLGIPYAQPPLGR

SEQ ID NO: 67082 - protein, 15 aa, Homo sapiens
HYTDWVDDQRPENYR

SEQ ID NO: 67083 - protein, 11 aa, Homo sapiens
IFFPGVSEFGK

SEQ ID NO: 67084 - protein, 10 aa, Homo sapiens
KDNNSIITRK

SEQ ID NO: 67085 - protein, 8 aa, Homo sapiens
KEFQEGLK

SEQ ID NO: 67086 - protein, 28 aa, Homo sapiens
KNATVLIWIYGGGFQTGTSSLHVYDGKF

SEQ ID NO: 67087 - protein, 10 aa, Homo sapiens
KTQILVGVNK

SEQ ID NO: 67088 - protein, 11 aa, Homo sapiens
KWSDIWNATKY

SEQ ID NO: 67089 - protein, 20 aa, Homo sapiens
KYGNPNETQNNSTSWPVFKS

SEQ ID NO: 67090 - protein, 12 aa, Homo sapiens
LGIPYAQPPLGR

SEQ ID NO: 67091 - protein, 13 aa, Homo sapiens
NAPWAVTSLYEAR

SEQ ID NO: 67092 - protein, 10 aa, Homo sapiens
NIAAFGGNPK

SEQ ID NO: 67093 - protein, 13 aa, Homo sapiens
NKDPQEILLNEAF

SEQ ID NO: 67094 - protein, 17 aa, Homo sapiens
NKDPQEILLNEAFVVPY

SEQ ID NO: 67095 - protein, 48 aa, Homo sapiens
NKDPQEILLNEAFVVPYGTPLSVNFGPTVDGDFLTDMPDILLELGQFK

SEQ ID NO: 67096 - protein, 9 aa, Homo sapiens
NQFNDYTSK

SEQ ID NO: 67097 - protein, 13 aa, Homo sapiens
RDNYTKAEEILSR

SEQ ID NO: 67098 - protein, 14 aa, Homo sapiens
RDNYTKAEEILSRS

SEQ ID NO: 67099 - protein, 10 aa, Homo sapiens
RENETEIIKC

SEQ ID NO: 67100 - protein, 16 aa, Homo sapiens
RGMNLTVFGGTVTAFL

SEQ ID NO: 67101 - protein, 28 aa, Homo sapiens
RGMNLTVFGGTVTAFLGIPYAQPPLGRL

SEQ ID NO: 67102 - protein, 27 aa, Homo sapiens
SVNFGPTVDGDFLTDMPDILLELGQFK

SEQ ID NO: 67103 - protein, 14 aa, Homo sapiens
TDMPDILLELGQFK

SEQ ID NO: 67104 - protein, 9 aa, Homo sapiens
TQILVGVNK

SEQ ID NO: 67105 - protein, 25 aa, Homo sapiens
TQILVGVNKDEGTAFLVYGAPGFSK

SEQ ID NO: 67106 - protein, 33 aa, Homo sapiens
VGALGFLALPGNPEAPGNMGLFDQQLALQWVQK

SEQ ID NO: 67107 - protein, 9 aa, Homo sapiens
VIVVSMNYR

SEQ ID NO: 67108 - protein, 16 aa, Homo sapiens
VLEMTGNIDEAEWEWK

SEQ ID NO: 67109 - protein, 9 aa, Homo sapiens
WNNYMMDWK

SEQ ID NO: 67110 - protein, 9 aa, Homo sapiens
WSDIWNATK

SEQ ID NO: 67111 - protein, 18 aa, Homo sapiens
YGNPNETQNNSTSWPVFK

SEQ ID NO: 67112 - protein, 10 aa, Homo sapiens
YLTLNTESTR

SEQ ID NO: 67113 - protein, 23 aa, Homo sapiens
RRAKGRVVNISSMLGRMANPARS

SEQ ID NO: 67114 - protein, 12 aa, Homo sapiens
AAPMDITLTETR

SEQ ID NO: 67115 - protein, 24 aa, Homo sapiens
ASISCTVENETIGVWRPSPPTCEK

SEQ ID NO: 67116 - protein, 16 aa, Homo sapiens
CEWETPEGCEQVLTGK

SEQ ID NO: 67117 - protein, 19 aa, Homo sapiens
CHPGYKPTTDEPTTVICQK

SEQ ID NO: 67118 - protein, 8 aa, Homo sapiens
CKPPPDIR

SEQ ID NO: 67119 - protein, 6 aa, Homo sapiens
DTIVFK

SEQ ID NO: 67120 - protein, 18 aa, Homo sapiens
DVSHGEMVSGFGPIYNYK

SEQ ID NO: 67121 - protein, 11 aa, Homo sapiens
EDVYVVGTVLR

SEQ ID NO: 67122 - protein, 9 aa, Homo sapiens
EEIIYECDK

SEQ ID NO: 67123 - protein, 17 aa, Homo sapiens
ENETIGVWRPSPPTCEK

SEQ ID NO: 67124 - protein, 9 aa, Homo sapiens
FLIGSTTSR

SEQ ID NO: 67125 - protein, 14 aa, Homo sapiens
FSAICQGDGTWSPR

SEQ ID NO: 67126 - protein, 8 aa, Homo sapiens
FSLLGHAS

SEQ ID NO: 67127 - protein, 22 aa, Homo sapiens
FSLLGHASISCTVENETIGVWR

SEQ ID NO: 67128 - protein, 30 aa, Homo sapiens
FSLLGHASISCTVENETIGVWRPSPPTCEK

SEQ ID NO: 67129 - protein, 15 aa, Homo sapiens
FYGDEISFSCHETSR

SEQ ID NO: 67130 - protein, 23 aa, Homo sapiens
GNCGPPPTLSFAAPMDITLTETR

SEQ ID NO: 67131 - protein, 12 aa, Homo sapiens
GSSVIHCDADSK

SEQ ID NO: 67132 - protein, 15 aa, Homo sapiens
GVGWSHPLPQCEIVK

SEQ ID NO: 67133 - protein, 9 aa, Homo sapiens
GYILVGQAK

SEQ ID NO: 67134 - protein, 6 aa, Homo sapiens
HPGELR

SEQ ID NO: 67135 - protein, 13 aa, Homo sapiens
HPGELRNGQVEIK

SEQ ID NO: 67136 - protein, 10 aa, Homo sapiens
HSGEENFYAY

SEQ ID NO: 67137 - protein, 12 aa, Homo sapiens
HSGEENFYAYGF

SEQ ID NO: 67138 - protein, 16 aa, Homo sapiens
HSGEENFYAYGFSVTY

SEQ ID NO: 67139 - protein, 19 aa, Homo sapiens
HSGEENFYAYGFSVTYSCD

SEQ ID NO: 67140 - protein, 21 aa, Homo sapiens
HSGEENFYAYGFSVTYSCDPR

SEQ ID NO: 67141 - protein, 7 aa, Homo sapiens
IAHGHYK

SEQ ID NO: 67142 - protein, 33 aa, Homo sapiens
KDQYVEPENVTIQCDSGYGVVGPQSITCSGNRT

SEQ ID NO: 67143 - protein, 13 aa, Homo sapiens
KPDVSHGEMVSGF

SEQ ID NO: 67144 - protein, 18 aa, Homo sapiens
KPDVSHGEMVSGFGPIYN

SEQ ID NO: 67145 - protein, 20 aa, Homo sapiens
KPDVSHGEMVSGFGPIYNYK

SEQ ID NO: 67146 - protein, 26 aa, Homo sapiens
KPDVSHGEMVSGFGPIYNYKDTIVFK

SEQ ID NO: 67147 - protein, 8 aa, Homo sapiens
KPELVNGR

SEQ ID NO: 67148 - protein, 10 aa, Homo sapiens
LEIEQLELQR

SEQ ID NO: 67149 - protein, 12 aa, Homo sapiens
LMQCLPNPEDVK

SEQ ID NO: 67150 - protein, 10 aa, Homo sapiens
LNNGEITQHR

SEQ ID NO: 67151 - protein, 11 aa, Homo sapiens
LNNGEITQHRK

SEQ ID NO: 67152 - protein, 16 aa, Homo sapiens
LSCSYSHWSAPAPQCK

SEQ ID NO: 67153 - protein, 20 aa, Homo sapiens
LSCSYSHWSAPAPQCKALCR

SEQ ID NO: 67154 - protein, 12 aa, Homo sapiens
LSLEIEQLELQR

SEQ ID NO: 67155 - protein, 19 aa, Homo sapiens
LSVDKDQYVEPENVTIQCD

SEQ ID NO: 67156 - protein, 36 aa, Homo sapiens
LSVDKDQYVEPENVTIQCDSGYGVVGPQSITCSGNR

SEQ ID NO: 67157 - protein, 7 aa, Homo sapiens
MALEVYK

SEQ ID NO: 67158 - protein, 22 aa, Homo sapiens
NCGPPPTLSFAAPMDITLTETR

SEQ ID NO: 67159 - protein, 16 aa, Homo sapiens
NETIGVWRPSPPTCEK

SEQ ID NO: 67160 - protein, 7 aa, Homo sapiens
NGQVEIK

SEQ ID NO: 67161 - protein, 22 aa, Homo sapiens
PANHCVYFYGDEISFSCHETSR

SEQ ID NO: 67162 - protein, 10 aa, Homo sapiens
PMDITLTETR

SEQ ID NO: 67163 - protein, 14 aa, Homo sapiens
PTKEDVYVVGTVLR

SEQ ID NO: 67164 - protein, 13 aa, Homo sapiens
PTTDEPTTVICQK

SEQ ID NO: 67165 - protein, 9 aa, Homo sapiens
QSSSYSFFK

SEQ ID NO: 67166 - protein, 18 aa, Homo sapiens
QSSSYSFFKEEIIYECDK

SEQ ID NO: 67167 - protein, 8 aa, Homo sapiens
QSTLDKEL

SEQ ID NO: 67168 - protein, 32 aa, Homo sapiens
RFSLLGHASISCTVENETIGVWRPSPPTCEKI

SEQ ID NO: 67169 - protein, 13 aa, Homo sapiens
RLMQCLPNPEDVK

SEQ ID NO: 67170 - protein, 38 aa, Homo sapiens
RLSVDKDQYVEPENVTIQCDSGYGVVGPQSITCSGNRT

SEQ ID NO: 67171 - protein, 13 aa, Homo sapiens
SEGFFLIGSTTSR

SEQ ID NO: 67172 - protein, 20 aa, Homo sapiens
SHSTQTLTCNSDGEWVYNTF

SEQ ID NO: 67173 - protein, 24 aa, Homo sapiens
SHSTQTLTCNSDGEWVYNTFCIYK

SEQ ID NO: 67174 - protein, 11 aa, Homo sapiens
SHWSAPAPQCK

SEQ ID NO: 67175 - protein, 11 aa, Homo sapiens
SLEIEQLELQR

SEQ ID NO: 67176 - protein, 24 aa, Homo sapiens
SRPANHCVYFYGDEISFSCHETSR

SEQ ID NO: 67177 - protein, 11 aa, Homo sapiens
TDLSFGSQIEF

SEQ ID NO: 67178 - protein, 12 aa, Homo sapiens
TDLSFGSQIEFS

SEQ ID NO: 67179 - protein, 26 aa, Homo sapiens
TDLSFGSQIEFSCSEGFFLIGSTTSR

SEQ ID NO: 67180 - protein, 12 aa, Homo sapiens
TPEGCEQVLTGK

SEQ ID NO: 67181 - protein, 13 aa, Homo sapiens
TPSCGDICNFPPK

SEQ ID NO: 67182 - protein, 8 aa, Homo sapiens
TWYPEVPK

SEQ ID NO: 67183 - protein, 24 aa, Homo sapiens
TWYPEVPKCEWETPEGCEQVLTGK

SEQ ID NO: 67184 - protein, 18 aa, Homo sapiens
VENETIGVWRPSPPTCEK

SEQ ID NO: 67185 - protein, 11 aa, Homo sapiens
VSGFGPIYNYK

SEQ ID NO: 67186 - protein, 9 aa, Homo sapiens
VYVVGTVLR

SEQ ID NO: 67187 - protein, 29 aa, Homo sapiens
WNPSPPACEPNSCINLPDIPHASWETYPR

SEQ ID NO: 67188 - protein, 32 aa, Homo sapiens
WNPSPPACEPNSCINLPDIPHASWETYPRPTK

SEQ ID NO: 67189 - protein, 16 aa, Homo sapiens
WTPYQGCEALCCPEPK

SEQ ID NO: 67190 - protein, 9 aa, Homo sapiens
YTCLPGYVR

SEQ ID NO: 67191 - protein, 18 aa, Homo sapiens
AEHCPELPPVDNSIFVAK

SEQ ID NO: 67192 - protein, 9 aa, Homo sapiens
ALLAFQESK

SEQ ID NO: 67193 - protein, 21 aa, Homo sapiens
ASDAEHCPELPPVDNSIFVAK

SEQ ID NO: 67194 - protein, 14 aa, Homo sapiens
EVEGQILGTYVCIK

SEQ ID NO: 67195 - protein, 10 aa, Homo sapiens
EWDNTTTECR

SEQ ID NO: 67196 - protein, 7 aa, Homo sapiens
GYHLVGK

SEQ ID NO: 67197 - protein, 12 aa, Homo sapiens
ITFMCNDHYILK

SEQ ID NO: 67198 - protein, 12 aa, Homo sapiens
KEWDNTTTECRL

SEQ ID NO: 67199 - protein, 10 aa, Homo sapiens
KTLFCNASKE

SEQ ID NO: 67200 - protein, 19 aa, Homo sapiens
KTLFCNASKEWDNTTTECR

SEQ ID NO: 67201 - protein, 25 aa, Homo sapiens
LGHCPDPVLVNGEFSSSGPVNVSDK

SEQ ID NO: 67202 - protein, 12 aa, Homo sapiens
LIQEAPKPECEK

SEQ ID NO: 67203 - protein, 14 aa, Homo sapiens
NLCEAMENFMQQLK

SEQ ID NO: 67204 - protein, 19 aa, Homo sapiens
PVLVNGEFSSSGPVNVSDK

SEQ ID NO: 67205 - protein, 33 aa, Homo sapiens
RDCDPPGNPVHGYFEGNNFTLGSTISYYCEDRY

SEQ ID NO: 67206 - protein, 27 aa, Homo sapiens
RLGHCPDPVLVNGEFSSSGPVNVSDKI

SEQ ID NO: 67207 - protein, 17 aa, Homo sapiens
SQCLEDHTWAPPFPICK

SEQ ID NO: 67208 - protein, 8 aa, Homo sapiens
TLFCNASK

SEQ ID NO: 67209 - protein, 18 aa, Homo sapiens
TLFCNASKEWDNTTTECR

SEQ ID NO: 67210 - protein, 6 aa, Homo sapiens
YSLELK

SEQ ID NO: 67211 - protein, 24 aa, Homo sapiens
YYLVGVQEQQCVDGEWSSALPVCK

SEQ ID NO: 67212 - protein, 16 aa, Homo sapiens
ADNFLLENTLPAQSTF

SEQ ID NO: 67213 - protein, 30 aa, Homo sapiens
ADNFLLENTLPAQSTFTLAISAYALSLGDK

SEQ ID NO: 67214 - protein, 9 aa, Homo sapiens
AFDICPLVK

SEQ ID NO: 67215 - protein, 13 aa, Homo sapiens
AFTECCVVASQLR

SEQ ID NO: 67216 - protein, 11 aa, Homo sapiens
AIAYSSLSQSY

SEQ ID NO: 67217 - protein, 12 aa, Homo sapiens
AIAYSSLSQSYL

SEQ ID NO: 67218 - protein, 21 aa, Homo sapiens
AIAYSSLSQSYLYIDWTDNHK

SEQ ID NO: 67219 - protein, 9 aa, Homo sapiens
ALLVGEHLN

SEQ ID NO: 67220 - protein, 15 aa, Homo sapiens
ALLVGEHLNIIVTPK

SEQ ID NO: 67221 - protein, 16 aa, Homo sapiens
ALVEGVDQLFTDYQIK

SEQ ID NO: 67222 - protein, 17 aa, Homo sapiens
AQTIDVNQETSDLDPSK

SEQ ID NO: 67223 - protein, 8 aa, Homo sapiens
ATLLDIYK

SEQ ID NO: 67224 - protein, 19 aa, Homo sapiens
AVMDISLPTGISANEEDLK

SEQ ID NO: 67225 - protein, 17 aa, Homo sapiens
CCYDGACVNNDETCEQR

SEQ ID NO: 67226 - protein, 22 aa, Homo sapiens
CVEADCGQMQEELDLTISAETR

SEQ ID NO: 67227 - protein, 14 aa, Homo sapiens
DGACVNNDETCEQR

SEQ ID NO: 67228 - protein, 20 aa, Homo sapiens
DGHVILQLNSIPSSDFLCVR

SEQ ID NO: 67229 - protein, 10 aa, Homo sapiens
DINYVNPVIK

SEQ ID NO: 67230 - protein, 21 aa, Homo sapiens
DNGFLFIHTDKPVYTPDQSVK

SEQ ID NO: 67231 - protein, 8 aa, Homo sapiens
DSEITFIK

SEQ ID NO: 67232 - protein, 11 aa, Homo sapiens
DSLTWIEYWPR

SEQ ID NO: 67233 - protein, 11 aa, Homo sapiens
DSSVPNTGTAR

SEQ ID NO: 67234 - protein, 10 aa, Homo sapiens
DVFLEMNIPY

SEQ ID NO: 67235 - protein, 14 aa, Homo sapiens
DVFLEMNIPYSVVR

SEQ ID NO: 67236 - protein, 6 aa, Homo sapiens
EALQIK

SEQ ID NO: 67237 - protein, 14 aa, Homo sapiens
EDFSTTGTAYFEVK

SEQ ID NO: 67238 - protein, 28 aa, Homo sapiens
EESSSGSSHAVMDISLPTGISANEEDLK

SEQ ID NO: 67239 - protein, 10 aa, Homo sapiens
EGMLSIMSYR

SEQ ID NO: 67240 - protein, 13 aa, Homo sapiens
ELSYYSLEDLNNK

SEQ ID NO: 67241 - protein, 28 aa, Homo sapiens
EMMQTAMQNTMLINGIAQVTFDSETAVK

SEQ ID NO: 67242 - protein, 15 aa, Homo sapiens
ENSLYLTAFTVIGIR

SEQ ID NO: 67243 - protein, 9 aa, Homo sapiens
ENSQYQPIK

SEQ ID NO: 67244 - protein, 11 aa, Homo sapiens
ESYSGVTLDPR

SEQ ID NO: 67245 - protein, 32 aa, Homo sapiens
ETVLTFIDPEGSEVDMVEEIDHIGIISFPDFK

SEQ ID NO: 67246 - protein, 16 aa, Homo sapiens
EYVLPHFSVSIEPEYN

SEQ ID NO: 67247 - protein, 17 aa, Homo sapiens
EYVLPHFSVSIEPEYNF

SEQ ID NO: 67248 - protein, 21 aa, Homo sapiens
EYVLPHFSVSIEPEYNFIGYK

SEQ ID NO: 67249 - protein, 18 aa, Homo sapiens
FLFIHTDKPVYTPDQSVK

SEQ ID NO: 67250 - protein, 11 aa, Homo sapiens
FLKPGIPYPIK

SEQ ID NO: 67251 - protein, 14 aa, Homo sapiens
FPESWLWEVHLVPR

SEQ ID NO: 67252 - protein, 12 aa, Homo sapiens
FQNSAILTIQPK

SEQ ID NO: 67253 - protein, 16 aa, Homo sapiens
FSDASYQSINIPVTQN

SEQ ID NO: 67254 - protein, 22 aa, Homo sapiens
FSDASYQSINIPVTQNMVPSSR

SEQ ID NO: 67255 - protein, 15 aa, Homo sapiens
FSVSIEPEYNFIGYK

SEQ ID NO: 67256 - protein, 15 aa, Homo sapiens
FSYSSGHVHLSSENK

SEQ ID NO: 67257 - protein, 7 aa, Homo sapiens
GALHNYK

SEQ ID NO: 67258 - protein, 21 aa, Homo sapiens
GEILSAVLSQEGINILTHLPK

SEQ ID NO: 67259 - protein, 11 aa, Homo sapiens
GGSASTWLTAF

SEQ ID NO: 67260 - protein, 14 aa, Homo sapiens
GGSASTWLTAFALR

SEQ ID NO: 67261 - protein, 14 aa, Homo sapiens
GIAQVTFDSETAVK

SEQ ID NO: 67262 - protein, 8 aa, Homo sapiens
GIYGTISR

SEQ ID NO: 67263 - protein, 25 aa, Homo sapiens
GLLVGEILSAVLSQEGINILTHLPK

SEQ ID NO: 67264 - protein, 26 aa, Homo sapiens
GLLVGEILSAVLSQEGINILTHLPKG

SEQ ID NO: 67265 - protein, 7 aa, Homo sapiens
GNPPIYR

SEQ ID NO: 67266 - protein, 9 aa, Homo sapiens
GRQYLIMGK

SEQ ID NO: 67267 - protein, 17 aa, Homo sapiens
GSAEAELMSVVPVFYVF

SEQ ID NO: 67268 - protein, 18 aa, Homo sapiens
GSAEAELMSVVPVFYVFH

SEQ ID NO: 67269 - protein, 21 aa, Homo sapiens
GSAEAELMSVVPVFYVFHYLE

SEQ ID NO: 67270 - protein, 37 aa, Homo sapiens
GSAEAELMSVVPVFYVFHYLETGNHWNIFHSDPLIEK

SEQ ID NO: 67271 - protein, 7 aa, Homo sapiens
GTVYNYR

SEQ ID NO: 67272 - protein, 8 aa, Homo sapiens
GYGNSDYK

SEQ ID NO: 67273 - protein, 9 aa, Homo sapiens
GYGNSDYKR

SEQ ID NO: 67274 - protein, 13 aa, Homo sapiens
GYTEAFDATISIK

SEQ ID NO: 67275 - protein, 8 aa, Homo sapiens
HSDPLIEK

SEQ ID NO: 67276 - protein, 7 aa, Homo sapiens
IDTALIK

SEQ ID NO: 67277 - protein, 12 aa, Homo sapiens
IDTQDIEASHYR

SEQ ID NO: 67278 - protein, 7 aa, Homo sapiens
IEEIAAK

SEQ ID NO: 67279 - protein, 15 aa, Homo sapiens
IEEIAAKYKHSVVKK

SEQ ID NO: 67280 - protein, 13 aa, Homo sapiens
IFELFEVGFLSPA

SEQ ID NO: 67281 - protein, 15 aa, Homo sapiens
IFELFEVGFLSPATF

SEQ ID NO: 67282 - protein, 10 aa, Homo sapiens
IFHSDPLIEK

SEQ ID NO: 67283 - protein, 15 aa, Homo sapiens
IHTDKPVYTPDQSVK

SEQ ID NO: 67284 - protein, 7 aa, Homo sapiens
IIHFGTR

SEQ ID NO: 67285 - protein, 8 aa, Homo sapiens
IPLDLVPK

SEQ ID NO: 67286 - protein, 11 aa, Homo sapiens
ITHYNYLILSK

SEQ ID NO: 67287 - protein, 11 aa, Homo sapiens
IVACASYKPSR

SEQ ID NO: 67288 - protein, 22 aa, Homo sapiens
IVTGEQTAELVSDSVWLNIEEK

SEQ ID NO: 67289 - protein, 10 aa, Homo sapiens
KAFDICPLVK

SEQ ID NO: 67290 - protein, 16 aa, Homo sapiens
KFSYSSGHVHLSSENK

SEQ ID NO: 67291 - protein, 8 aa, Homo sapiens
KIEEIAAK

SEQ ID NO: 67292 - protein, 14 aa, Homo sapiens
KQTACKPEIAYAYK

SEQ ID NO: 67293 - protein, 35 aa, Homo sapiens
KVEGSSSHLVTFTVLPLEIGLHNINFSLETWFGKE

SEQ ID NO: 67294 - protein, 11 aa, Homo sapiens
KVTCTNAELVK

SEQ ID NO: 67295 - protein, 8 aa, Homo sapiens
KYNFSFRY

SEQ ID NO: 67296 - protein, 13 aa, Homo sapiens
LAAVDSAVYGVQR

SEQ ID NO: 67297 - protein, 17 aa, Homo sapiens
LFIHTDKPVYTPDQSVK

SEQ ID NO: 67298 - protein, 27 aa, Homo sapiens
LLVYYIVTGEQTAELVSDSVWLNIEEK

SEQ ID NO: 67299 - protein, 11 aa, Homo sapiens
LNLVATPLFLK

SEQ ID NO: 67300 - protein, 19 aa, Homo sapiens
LNLVATPLFLKPGIPYPIK

SEQ ID NO: 67301 - protein, 10 aa, Homo sapiens
LQGTLPVEAR

SEQ ID NO: 67302 - protein, 10 aa, Homo sapiens
LSMDIDVSYK

SEQ ID NO: 67303 - protein, 12 aa, Homo sapiens
LSMDIDVSYKHK

SEQ ID NO: 67304 - protein, 13 aa, Homo sapiens
LVENYQLDNGSFK

SEQ ID NO: 67305 - protein, 10 aa, Homo sapiens
LYIDWTDNHK

SEQ ID NO: 67306 - protein, 16 aa, Homo sapiens
MPITYDNGFLFIHTDK

SEQ ID NO: 67307 - protein, 17 aa, Homo sapiens
MPITYDNGFLFIHTDKP

SEQ ID NO: 67308 - protein, 26 aa, Homo sapiens
MPITYDNGFLFIHTDKPVYTPDQSVK

SEQ ID NO: 67309 - protein, 21 aa, Homo sapiens
MSAVEGICTSESPVIDHQGTK

SEQ ID NO: 67310 - protein, 16 aa, Homo sapiens
MVETTAYALLTSLNLK

SEQ ID NO: 67311 - protein, 26 aa, Homo sapiens
MVETTAYALLTSLNLKDINYVNPVIK

SEQ ID NO: 67312 - protein, 10 aa, Homo sapiens
NADYSYSVWK

SEQ ID NO: 67313 - protein, 18 aa, Homo sapiens
NAQTIDVNQETSDLDPSK

SEQ ID NO: 67314 - protein, 7 aa, Homo sapiens
NFEITIK

SEQ ID NO: 67315 - protein, 9 aa, Homo sapiens
NFEITIKAR

SEQ ID NO: 67316 - protein, 8 aa, Homo sapiens
NYVNPVIK

SEQ ID NO: 67317 - protein, 10 aa, Homo sapiens
PDLPEENQAR

SEQ ID NO: 67318 - protein, 8 aa, Homo sapiens
PGIPYPIK

SEQ ID NO: 67319 - protein, 7 aa, Homo sapiens
PLDLVPK

SEQ ID NO: 67320 - protein, 8 aa, Homo sapiens
PVSKPEIR

SEQ ID NO: 67321 - protein, 10 aa, Homo sapiens
PVYTPDQSVK

SEQ ID NO: 67322 - protein, 12 aa, Homo sapiens
QCTMFYSTSNIK

SEQ ID NO: 67323 - protein, 19 aa, Homo sapiens
QLPGGQNPVSYVYLEVVSK

SEQ ID NO: 67324 - protein, 13 aa, Homo sapiens
QTACKPEIAYAYK

SEQ ID NO: 67325 - protein, 14 aa, Homo sapiens
RANISHKDMQLGRL

SEQ ID NO: 67326 - protein, 12 aa, Homo sapiens
RIVACASYKPSR

SEQ ID NO: 67327 - protein, 7 aa, Homo sapiens
RKEFPYR

SEQ ID NO: 67328 - protein, 27 aa, Homo sapiens
RMPITYDNGFLFIHTDKPVYTPDQSVK

SEQ ID NO: 67329 - protein, 13 aa, Homo sapiens
RVYSLNDDLKPAK

SEQ ID NO: 67330 - protein, 17 aa, Homo sapiens
SAVLSQEGINILTHLPK

SEQ ID NO: 67331 - protein, 10 aa, Homo sapiens
SITVENVFVK

SEQ ID NO: 67332 - protein, 17 aa, Homo sapiens
SLLWLVENYQLDNGSFK

SEQ ID NO: 67333 - protein, 17 aa, Homo sapiens
SPYIDKITHYNYLILSK

SEQ ID NO: 67334 - protein, 14 aa, Homo sapiens
SQSYLYIDWTDNHK

SEQ ID NO: 67335 - protein, 12 aa, Homo sapiens
SSGHVHLSSENK

SEQ ID NO: 67336 - protein, 17 aa, Homo sapiens
SSLSQSYLYIDWTDNHK

SEQ ID NO: 67337 - protein, 20 aa, Homo sapiens
STQDTINAIEGLTEYSLLVK

SEQ ID NO: 67338 - protein, 11 aa, Homo sapiens
STTGTAYFEVK

SEQ ID NO: 67339 - protein, 14 aa, Homo sapiens
SVSIEPEYNFIGYK

SEQ ID NO: 67340 - protein, 16 aa, Homo sapiens
SYFPESWLWEVHLVPR

SEQ ID NO: 67341 - protein, 11 aa, Homo sapiens
SYYSLEDLNNK

SEQ ID NO: 67342 - protein, 13 aa, Homo sapiens
TDAPDLPEENQAR

SEQ ID NO: 67343 - protein, 11 aa, Homo sapiens
TEAFDATISIK

SEQ ID NO: 67344 - protein, 8 aa, Homo sapiens
TGEAVAEK

SEQ ID NO: 67345 - protein, 16 aa, Homo sapiens
TGEAVAEKDSEITFIK

SEQ ID NO: 67346 - protein, 10 aa, Homo sapiens
THYNYLILSK

SEQ ID NO: 67347 - protein, 15 aa, Homo sapiens
TIDVNQETSDLDPSK

SEQ ID NO: 67348 - protein, 14 aa, Homo sapiens
TLAISAYALSLGDK

SEQ ID NO: 67349 - protein, 11 aa, Homo sapiens
TLLPVSKPEIR

SEQ ID NO: 67350 - protein, 12 aa, Homo sapiens
TLQKKIEEIAAK

SEQ ID NO: 67351 - protein, 20 aa, Homo sapiens
TLQKKIEEIAAKYKHSVVKK

SEQ ID NO: 67352 - protein, 19 aa, Homo sapiens
TMLINGIAQVTFDSETAVK

SEQ ID NO: 67353 - protein, 9 aa, Homo sapiens
TSGMQFCVK

SEQ ID NO: 67354 - protein, 13 aa, Homo sapiens
TSTSEEVCSFYLK

SEQ ID NO: 67355 - protein, 15 aa, Homo sapiens
VALAAVDSAVYGVQR

SEQ ID NO: 67356 - protein, 8 aa, Homo sapiens
VCEGAACK

SEQ ID NO: 67357 - protein, 19 aa, Homo sapiens
VDDGVASFVLNLPSGVTVL

SEQ ID NO: 67358 - protein, 21 aa, Homo sapiens
VDDGVASFVLNLPSGVTVLEF

SEQ ID NO: 67359 - protein, 24 aa, Homo sapiens
VDDGVASFVLNLPSGVTVLEFNVK

SEQ ID NO: 67360 - protein, 11 aa, Homo sapiens
VEGSSSHLVTF

SEQ ID NO: 67361 - protein, 22 aa, Homo sapiens
VFHYLETGNHWNIFHSDPLIEK

SEQ ID NO: 67362 - protein, 7 aa, Homo sapiens
VFQFLEK

SEQ ID NO: 67363 - protein, 25 aa, Homo sapiens
VGASENIVIQVYGYTEAFDATISIK

SEQ ID NO: 67364 - protein, 22 aa, Homo sapiens
VGEILSAVLSQEGINILTHLPK

SEQ ID NO: 67365 - protein, 7 aa, Homo sapiens
VLGQVNK

SEQ ID NO: 67366 - protein, 16 aa, Homo sapiens
VLNLPSGVTVLEFNVK

SEQ ID NO: 67367 - protein, 12 aa, Homo sapiens
VSITSITVENVF

SEQ ID NO: 67368 - protein, 14 aa, Homo sapiens
VSITSITVENVFVK

SEQ ID NO: 67369 - protein, 10 aa, Homo sapiens
VTCTNAELVK

SEQ ID NO: 67370 - protein, 14 aa, Homo sapiens
VVTEADVYITFGIR

SEQ ID NO: 67371 - protein, 8 aa, Homo sapiens
VYLEVVSK

SEQ ID NO: 67372 - protein, 12 aa, Homo sapiens
VYSLNDDLKPAK

SEQ ID NO: 67373 - protein, 13 aa, Homo sapiens
VYSLNDDLKPAKR

SEQ ID NO: 67374 - protein, 7 aa, Homo sapiens
WLSEEQR

SEQ ID NO: 67375 - protein, 14 aa, Homo sapiens
WLVENYQLDNGSFK

SEQ ID NO: 67376 - protein, 26 aa, Homo sapiens
YGGGFYSTQDTINAIEGLTEYSLLVK

SEQ ID NO: 67377 - protein, 7 aa, Homo sapiens
YGMWTIK

SEQ ID NO: 67378 - protein, 9 aa, Homo sapiens
YIDWTDNHK

SEQ ID NO: 67379 - protein, 23 aa, Homo sapiens
YIVTGEQTAELVSDSVWLNIEEK

SEQ ID NO: 67380 - protein, 16 aa, Homo sapiens
YIYPLDSLTWIEYWPR

SEQ ID NO: 67381 - protein, 12 aa, Homo sapiens
YKEDFSTTGTAY

SEQ ID NO: 67382 - protein, 16 aa, Homo sapiens
YKEDFSTTGTAYFEVK

SEQ ID NO: 67383 - protein, 6 aa, Homo sapiens
YNFSFR

SEQ ID NO: 67384 - protein, 21 aa, Homo sapiens
YSTQDTINAIEGLTEYSLLVK

SEQ ID NO: 67385 - protein, 28 aa, Homo sapiens
YVEQNQNSICNSLLWLVENYQLDNGSFK

SEQ ID NO: 67386 - protein, 7 aa, Homo sapiens
YVLSPYK

SEQ ID NO: 67387 - protein, 26 aa, Homo sapiens
YVLSPYKLNLVATPLFLKPGIPYPIK

SEQ ID NO: 67388 - protein, 7 aa, Homo sapiens
YVNPVIK

SEQ ID NO: 67389 - protein, 12 aa, Homo sapiens
AKDLHLSDVFLK

SEQ ID NO: 67390 - protein, 14 aa, Homo sapiens
ALNHLPLEYNSALY

SEQ ID NO: 67391 - protein, 16 aa, Homo sapiens
ALNHLPLEYNSALYSR

SEQ ID NO: 67392 - protein, 8 aa, Homo sapiens
ALQEYAAK

SEQ ID NO: 67393 - protein, 19 aa, Homo sapiens
CLNNQQLHFLHIGSCQDGR

SEQ ID NO: 67394 - protein, 22 aa, Homo sapiens
CPINCLLGDFGPWSDCDPCIEK

SEQ ID NO: 67395 - protein, 11 aa, Homo sapiens
CVCLLPPQCFK

SEQ ID NO: 67396 - protein, 10 aa, Homo sapiens
DLHLSDVFLK

SEQ ID NO: 67397 - protein, 12 aa, Homo sapiens
DLLYQFSSEELK

SEQ ID NO: 67398 - protein, 15 aa, Homo sapiens
DLTSLGHNENQQGSF

SEQ ID NO: 67399 - protein, 23 aa, Homo sapiens
DLTSLGHNENQQGSFSSQGGSSF

SEQ ID NO: 67400 - protein, 29 aa, Homo sapiens
DLTSLGHNENQQGSFSSQGGSSFSVPIFY

SEQ ID NO: 67401 - protein, 32 aa, Homo sapiens
DLTSLGHNENQQGSFSSQGGSSFSVPIFYSSK

SEQ ID NO: 67402 - protein, 9 aa, Homo sapiens
ECNNPAPQR

SEQ ID NO: 67403 - protein, 6 aa, Homo sapiens
ECNWQR

SEQ ID NO: 67404 - protein, 18 aa, Homo sapiens
ENPAVIDFELAPIVDLVR

SEQ ID NO: 67405 - protein, 13 aa, Homo sapiens
ESCGYDTCYDWEK

SEQ ID NO: 67406 - protein, 25 aa, Homo sapiens
EVDLPEIEADSGCPQPVPPENGFIR

SEQ ID NO: 67407 - protein, 22 aa, Homo sapiens
FTSGSLGGVYDLLYQFSSEELK

SEQ ID NO: 67408 - protein, 14 aa, Homo sapiens
GEVLDNSFTGGICK

SEQ ID NO: 67409 - protein, 9 aa, Homo sapiens
GFVVAGPSR

SEQ ID NO: 67410 - protein, 9 aa, Homo sapiens
GGNQLYCVK

SEQ ID NO: 67411 - protein, 14 aa, Homo sapiens
GGRSEYGAALAWEK

SEQ ID NO: 67412 - protein, 22 aa, Homo sapiens
GGRSEYGAALAWEKGSSGLEEK

SEQ ID NO: 67413 - protein, 8 aa, Homo sapiens
GHCQLGQK

SEQ ID NO: 67414 - protein, 15 aa, Homo sapiens
GVYDLLYQFSSEELK

SEQ ID NO: 67415 - protein, 11 aa, Homo sapiens
HEGSFIQGAEK

SEQ ID NO: 67416 - protein, 7 aa, Homo sapiens
IEEADCK

SEQ ID NO: 67417 - protein, 11 aa, Homo sapiens
IEEADCKNKFR

SEQ ID NO: 67418 - protein, 9 aa, Homo sapiens
IFDDFGTHY

SEQ ID NO: 67419 - protein, 31 aa, Homo sapiens
IFDDFGTHYFTSGSLGGVYDLLYQFSSEELK

SEQ ID NO: 67420 - protein, 11 aa, Homo sapiens
IGESIELTCPK

SEQ ID NO: 67421 - protein, 9 aa, Homo sapiens
KALQEYAAK

SEQ ID NO: 67422 - protein, 14 aa, Homo sapiens
KESCGYDTCYDWEK

SEQ ID NO: 67423 - protein, 17 aa, Homo sapiens
KLECNGENDCGDNSDER

SEQ ID NO: 67424 - protein, 9 aa, Homo sapiens
KMEILHPGK

SEQ ID NO: 67425 - protein, 9 aa, Homo sapiens
KVLNFTTKA

SEQ ID NO: 67426 - protein, 23 aa, Homo sapiens
KYNPIPSVQLMGNGFHFLAGEPR

SEQ ID NO: 67427 - protein, 10 aa, Homo sapiens
LKGHCQLGQK

SEQ ID NO: 67428 - protein, 15 aa, Homo sapiens
LSEKHEGSFIQGAEK

SEQ ID NO: 67429 - protein, 21 aa, Homo sapiens
LSSNSTKKESCGYDTCYDWEK

SEQ ID NO: 67430 - protein, 28 aa, Homo sapiens
LSSNSTKKESCGYDTCYDWEKCSASTSK

SEQ ID NO: 67431 - protein, 8 aa, Homo sapiens
MEILHPGK

SEQ ID NO: 67432 - protein, 19 aa, Homo sapiens
MGSSTSEKTLNICEVGTIR

SEQ ID NO: 67433 - protein, 8 aa, Homo sapiens
NIPCAVTK

SEQ ID NO: 67434 - protein, 10 aa, Homo sapiens
NSGLTEEEAK

SEQ ID NO: 67435 - protein, 16 aa, Homo sapiens
PAVIDFELAPIVDLVR

SEQ ID NO: 67436 - protein, 11 aa, Homo sapiens
PLEYNSALYSR

SEQ ID NO: 67437 - protein, 23 aa, Homo sapiens
PSQFGGQPCTEPLVAFQPCIPSK

SEQ ID NO: 67438 - protein, 8 aa, Homo sapiens
QGDVECQR

SEQ ID NO: 67439 - protein, 8 aa, Homo sapiens
QLEWGLER

SEQ ID NO: 67440 - protein, 9 aa, Homo sapiens
RLSSNSTKK

SEQ ID NO: 67441 - protein, 26 aa, Homo sapiens
RQEEDCTFSIMENNGQPCINDDEEMK

SEQ ID NO: 67442 - protein, 12 aa, Homo sapiens
RSENINHNSAFK

SEQ ID NO: 67443 - protein, 21 aa, Homo sapiens
RSENINHNSAFKQAIQASHKK

SEQ ID NO: 67444 - protein, 11 aa, Homo sapiens
RTRLSSNSTKK

SEQ ID NO: 67445 - protein, 11 aa, Homo sapiens
SENINHNSAFK

SEQ ID NO: 67446 - protein, 11 aa, Homo sapiens
SEYGAALAWEK

SEQ ID NO: 67447 - protein, 18 aa, Homo sapiens
SLGGVYDLLYQFSSEELK

SEQ ID NO: 67448 - protein, 17 aa, Homo sapiens
SSQGGSSFSVPIFYSSK

SEQ ID NO: 67449 - protein, 8 aa, Homo sapiens
SVLRPSQF

SEQ ID NO: 67450 - protein, 27 aa, Homo sapiens
SVLRPSQFGGQPCTEPLVAFQPCIPSK

SEQ ID NO: 67451 - protein, 14 aa, Homo sapiens
SVLYFILLNALINK

SEQ ID NO: 67452 - protein, 17 aa, Homo sapiens
TECIKPVVQEVLTITPF

SEQ ID NO: 67453 - protein, 19 aa, Homo sapiens
TECIKPVVQEVLTITPFQR

SEQ ID NO: 67454 - protein, 10 aa, Homo sapiens
TFSEWLESVK

SEQ ID NO: 67455 - protein, 28 aa, Homo sapiens
TFSEWLESVKENPAVIDFELAPIVDLVR

SEQ ID NO: 67456 - protein, 11 aa, Homo sapiens
TLNICEVGTIR

SEQ ID NO: 67457 - protein, 11 aa, Homo sapiens
TRECNNPAPQR

SEQ ID NO: 67458 - protein, 21 aa, Homo sapiens
TSGSLGGVYDLLYQFSSEELK

SEQ ID NO: 67459 - protein, 6 aa, Homo sapiens
TSNPYR

SEQ ID NO: 67460 - protein, 13 aa, Homo sapiens
VGFEVQTAEDDLK

SEQ ID NO: 67461 - protein, 7 aa, Homo sapiens
VLNFTTK

SEQ ID NO: 67462 - protein, 10 aa, Homo sapiens
VMKVLNFTTK

SEQ ID NO: 67463 - protein, 20 aa, Homo sapiens
VPANLENVGFEVQTAEDDLK

SEQ ID NO: 67464 - protein, 25 aa, Homo sapiens
VPANLENVGFEVQTAEDDLKTDFYK

SEQ ID NO: 67465 - protein, 22 aa, Homo sapiens
YNPIPSVQLMGNGFHFLAGEPR

SEQ ID NO: 67466 - protein, 20 aa, Homo sapiens
YTCQGNSWTPPISNSLTCEK

SEQ ID NO: 67467 - protein, 25 aa, Homo sapiens
YTCQGNSWTPPISNSLTCEKDTLTK

SEQ ID NO: 67468 - protein, 13 aa, Homo sapiens
YYQENFCEQICSK

SEQ ID NO: 67469 - protein, 17 aa, Homo sapiens
AIDEDCSQYEPIPGSQK

SEQ ID NO: 67470 - protein, 13 aa, Homo sapiens
ALDQYLMEFNACR

SEQ ID NO: 67471 - protein, 10 aa, Homo sapiens
AMAVEDIISR

SEQ ID NO: 67472 - protein, 12 aa, Homo sapiens
AMAVEDIISRVR

SEQ ID NO: 67473 - protein, 18 aa, Homo sapiens
CGPCFNNGVPILEGTSCR

SEQ ID NO: 67474 - protein, 27 aa, Homo sapiens
DDIMLDEGMLQSLMELPDQYNYGMYAK

SEQ ID NO: 67475 - protein, 17 aa, Homo sapiens
DITTCFGGSLGIQYEDK

SEQ ID NO: 67476 - protein, 17 aa, Homo sapiens
ECDNPAPQNGGASCPGR

SEQ ID NO: 67477 - protein, 8 aa, Homo sapiens
FGGGKTER

SEQ ID NO: 67478 - protein, 12 aa, Homo sapiens
FGGSLGIQYEDK

SEQ ID NO: 67479 - protein, 24 aa, Homo sapiens
FGGTICSGDIWDQASCSSSTTCVR

SEQ ID NO: 67480 - protein, 9 aa, Homo sapiens
FINDYGTHY

SEQ ID NO: 67481 - protein, 14 aa, Homo sapiens
FINDYGTHYITSGS

SEQ ID NO: 67482 - protein, 21 aa, Homo sapiens
FINDYGTHYITSGSMGGIYEY

SEQ ID NO: 67483 - protein, 27 aa, Homo sapiens
FINDYGTHYITSGSMGGIYEYILVIDK

SEQ ID NO: 67484 - protein, 11 aa, Homo sapiens
GGSLGIQYEDK

SEQ ID NO: 67485 - protein, 14 aa, Homo sapiens
GGSSGWSGGLAQNR

SEQ ID NO: 67486 - protein, 23 aa, Homo sapiens
HLVCNGDQDCLDGSDEDDCEDVR

SEQ ID NO: 67487 - protein, 10 aa, Homo sapiens
HTSLGPLEAK

SEQ ID NO: 67488 - protein, 11 aa, Homo sapiens
HTSLGPLEAKR

SEQ ID NO: 67489 - protein, 13 aa, Homo sapiens
INVGGGLSGDHCK

SEQ ID NO: 67490 - protein, 14 aa, Homo sapiens
INVGGGLSGDHCKK

SEQ ID NO: 67491 - protein, 11 aa, Homo sapiens
KAMAVEDIISR

SEQ ID NO: 67492 - protein, 13 aa, Homo sapiens
KAMAVEDIISRVR

SEQ ID NO: 67493 - protein, 28 aa, Homo sapiens
KDDIMLDEGMLQSLMELPDQYNYGMYAK

SEQ ID NO: 67494 - protein, 7 aa, Homo sapiens
KPYNFLK

SEQ ID NO: 67495 - protein, 17 aa, Homo sapiens
LGSLGAACEQTQTEGAK

SEQ ID NO: 67496 - protein, 20 aa, Homo sapiens
LVGVGVSHSQDTSFLNELNK

SEQ ID NO: 67497 - protein, 8 aa, Homo sapiens
LYYGDDEK

SEQ ID NO: 67498 - protein, 11 aa, Homo sapiens
LYYGDDEKYFR

SEQ ID NO: 67499 - protein, 9 aa, Homo sapiens
MESLGITSR

SEQ ID NO: 67500 - protein, 16 aa, Homo sapiens
PVVIDFEMQPIHEVLR

SEQ ID NO: 67501 - protein, 11 aa, Homo sapiens
QAQCGQDFQCK

SEQ ID NO: 67502 - protein, 16 aa, Homo sapiens
RGGSSGWSGGLAQNRS

SEQ ID NO: 67503 - protein, 37 aa, Homo sapiens
SDSFGVTIGIGPAGSPLLVGVGVSHSQDTSFLNELNK

SEQ ID NO: 67504 - protein, 21 aa, Homo sapiens
SLKYNPVVIDFEMQPIHEVLR

SEQ ID NO: 67505 - protein, 7 aa, Homo sapiens
SLLQPNK

SEQ ID NO: 67506 - protein, 23 aa, Homo sapiens
SPLLVGVGVSHSQDTSFLNELNK

SEQ ID NO: 67507 - protein, 12 aa, Homo sapiens
SQDTSFLNELNK

SEQ ID NO: 67508 - protein, 7 aa, Homo sapiens
VQTAHFK

SEQ ID NO: 67509 - protein, 16 aa, Homo sapiens
VRGGSSGWSGGLAQNR

SEQ ID NO: 67510 - protein, 25 aa, Homo sapiens
YHFEALADTGISSEFYDNANDLLSK

SEQ ID NO: 67511 - protein, 18 aa, Homo sapiens
YNPVVIDFEMQPIHEVLR

SEQ ID NO: 67512 - protein, 19 aa, Homo sapiens
ASGINLFTNSFEGPVLDHR

SEQ ID NO: 67513 - protein, 26 aa, Homo sapiens
AYQELPTADLMQEWGDAVQYNPAIIK

SEQ ID NO: 67514 - protein, 19 aa, Homo sapiens
CDCICPVGSQGLACEVSYR

SEQ ID NO: 67515 - protein, 11 aa, Homo sapiens
CEGFVCAQTGR

SEQ ID NO: 67516 - protein, 18 aa, Homo sapiens
DFGTHYITEAVLGGIYEY

SEQ ID NO: 67517 - protein, 24 aa, Homo sapiens
DFGTHYITEAVLGGIYEYTLVMNK

SEQ ID NO: 67518 - protein, 12 aa, Homo sapiens
DTMVEDLVVLVR

SEQ ID NO: 67519 - protein, 18 aa, Homo sapiens
EAMERGDYTLNNVHACAK

SEQ ID NO: 67520 - protein, 10 aa, Homo sapiens
ELGISSQSDR

SEQ ID NO: 67521 - protein, 15 aa, Homo sapiens
ELVTATDFAYSSTVR

SEQ ID NO: 67522 - protein, 13 aa, Homo sapiens
ESYSDFERNVTEK

SEQ ID NO: 67523 - protein, 19 aa, Homo sapiens
EVSSCHCAPCQGNGVPVLK

SEQ ID NO: 67524 - protein, 10 aa, Homo sapiens
EYESYSDFER

SEQ ID NO: 67525 - protein, 15 aa, Homo sapiens
EYESYSDFERNVTEK

SEQ ID NO: 67526 - protein, 17 aa, Homo sapiens
FRKPYNVESYTPQTQGK

SEQ ID NO: 67527 - protein, 13 aa, Homo sapiens
GDYTLNNVHACAK

SEQ ID NO: 67528 - protein, 33 aa, Homo sapiens
GGASEHITTLAYQELPTADLMQEWGDAVQYNPA

SEQ ID NO: 67529 - protein, 36 aa, Homo sapiens
GGASEHITTLAYQELPTADLMQEWGDAVQYNPAIIK

SEQ ID NO: 67530 - protein, 24 aa, Homo sapiens
GIGSLASGINLFTNSFEGPVLDHR

SEQ ID NO: 67531 - protein, 9 aa, Homo sapiens
GILNEIKDR

SEQ ID NO: 67532 - protein, 17 aa, Homo sapiens
GINLFTNSFEGPVLDHR

SEQ ID NO: 67533 - protein, 18 aa, Homo sapiens
IGGAIEEVYVSLGVSVGK

SEQ ID NO: 67534 - protein, 15 aa, Homo sapiens
IPGIFELGISSQSDR

SEQ ID NO: 67535 - protein, 18 aa, Homo sapiens
ITEAVLGGIYEYTLVMNK

SEQ ID NO: 67536 - protein, 17 aa, Homo sapiens
KEYESYSDFERNVTEKM

SEQ ID NO: 67537 - protein, 15 aa, Homo sapiens
KPYNVESYTPQTQGK

SEQ ID NO: 67538 - protein, 19 aa, Homo sapiens
LLCNGDNDCGDQSDEANCR

SEQ ID NO: 67539 - protein, 17 aa, Homo sapiens
LLQPSQFHGEPCNFSDK

SEQ ID NO: 67540 - protein, 7 aa, Homo sapiens
LNEIKDR

SEQ ID NO: 67541 - protein, 11 aa, Homo sapiens
LPLEYSYGEYR

SEQ ID NO: 67542 - protein, 12 aa, Homo sapiens
NVESYTPQTQGK

SEQ ID NO: 67543 - protein, 12 aa, Homo sapiens
RLPLEYSYGEYR

SEQ ID NO: 67544 - protein, 9 aa, Homo sapiens
SDLEVAHYK

SEQ ID NO: 67545 - protein, 13 aa, Homo sapiens
SDLEVAHYKLKPR

SEQ ID NO: 67546 - protein, 10 aa, Homo sapiens
SFEGPVLDHR

SEQ ID NO: 67547 - protein, 8 aa, Homo sapiens
SGFSFGFK

SEQ ID NO: 67548 - protein, 21 aa, Homo sapiens
SLASGINLFTNSFEGPVLDHR

SEQ ID NO: 67549 - protein, 11 aa, Homo sapiens
SLMLHYEFLQR

SEQ ID NO: 67550 - protein, 7 aa, Homo sapiens
SVFLHAR

SEQ ID NO: 67551 - protein, 12 aa, Homo sapiens
SYSDFERNVTEK

SEQ ID NO: 67552 - protein, 12 aa, Homo sapiens
TNSFEGPVLDHR

SEQ ID NO: 67553 - protein, 15 aa, Homo sapiens
VEPLYELVTATDFAY

SEQ ID NO: 67554 - protein, 20 aa, Homo sapiens
VEPLYELVTATDFAYSSTVR

SEQ ID NO: 67555 - protein, 17 aa, Homo sapiens
VKVEPLYELVTATDFAY

SEQ ID NO: 67556 - protein, 22 aa, Homo sapiens
VKVEPLYELVTATDFAYSSTVR

SEQ ID NO: 67557 - protein, 20 aa, Homo sapiens
YAYLLQPSQFHGEPCNFSDK

SEQ ID NO: 67558 - protein, 11 aa, Homo sapiens
YSDFERNVTEK

SEQ ID NO: 67559 - protein, 15 aa, Homo sapiens
YYAGGCSPHYILNTR

SEQ ID NO: 67560 - protein, 12 aa, Homo sapiens
AADQFHVLDEVR

SEQ ID NO: 67561 - protein, 14 aa, Homo sapiens
AEATTLHVAPQGTA

SEQ ID NO: 67562 - protein, 15 aa, Homo sapiens
AEATTLHVAPQGTAM

SEQ ID NO: 67563 - protein, 21 aa, Homo sapiens
AEATTLHVAPQGTAMAVSTFR

SEQ ID NO: 67564 - protein, 8 aa, Homo sapiens
AMAVSTFR

SEQ ID NO: 67565 - protein, 8 aa, Homo sapiens
ANFDAQQF

SEQ ID NO: 67566 - protein, 12 aa, Homo sapiens
ANFDAQQFAGTW

SEQ ID NO: 67567 - protein, 13 aa, Homo sapiens
ANFDAQQFAGTWL

SEQ ID NO: 67568 - protein, 22 aa, Homo sapiens
ANFDAQQFAGTWLLVAVGSACR

SEQ ID NO: 67569 - protein, 8 aa, Homo sapiens
FLQEQGHR

SEQ ID NO: 67570 - protein, 15 aa, Homo sapiens
GAVHVVVAETDYQSF

SEQ ID NO: 67571 - protein, 18 aa, Homo sapiens
GAVHVVVAETDYQSFAVL

SEQ ID NO: 67572 - protein, 7 aa, Homo sapiens
HVLDEVR

SEQ ID NO: 67573 - protein, 10 aa, Homo sapiens
KLDGICWQVR

SEQ ID NO: 67574 - protein, 9 aa, Homo sapiens
LDGICWQVR

SEQ ID NO: 67575 - protein, 11 aa, Homo sapiens
LTEDQIFYFPK

SEQ ID NO: 67576 - protein, 11 aa, Homo sapiens
PASPISTIQPK

SEQ ID NO: 67577 - protein, 13 aa, Homo sapiens
PVSDSVLSGFEQR

SEQ ID NO: 67578 - protein, 11 aa, Homo sapiens
QLYGDTGVLGR

SEQ ID NO: 67579 - protein, 12 aa, Homo sapiens
RPASPISTIQPK

SEQ ID NO: 67580 - protein, 15 aa, Homo sapiens
SLPVSDSVLSGFEQR

SEQ ID NO: 67581 - protein, 10 aa, Homo sapiens
TEDQIFYFPK

SEQ ID NO: 67582 - protein, 14 aa, Homo sapiens
VAPQGTAMAVSTFR

SEQ ID NO: 67583 - protein, 16 aa, Homo sapiens
VQEAHLTEDQIFYFPK

SEQ ID NO: 67584 - protein, 17 aa, Homo sapiens
YGFCEAADQFHVLDEVR

SEQ ID NO: 67585 - protein, 18 aa, Homo sapiens
YGFCEAADQFHVLDEVRR

SEQ ID NO: 67586 - protein, 17 aa, Homo sapiens
AEQCCEETASSISLHGK

SEQ ID NO: 67587 - protein, 12 aa, Homo sapiens
AIEDYINEFSVR

SEQ ID NO: 67588 - protein, 13 aa, Homo sapiens
AIEDYINEFSVRK

SEQ ID NO: 67589 - protein, 8 aa, Homo sapiens
ALPTTYEK

SEQ ID NO: 67590 - protein, 18 aa, Homo sapiens
AVNITSENLIDDVVSLIR

SEQ ID NO: 67591 - protein, 16 aa, Homo sapiens
CHTCQNGGTVILMDGK

SEQ ID NO: 67592 - protein, 8 aa, Homo sapiens
CLCACPFK

SEQ ID NO: 67593 - protein, 18 aa, Homo sapiens
CLCACPFKFEGIACEISK

SEQ ID NO: 67594 - protein, 25 aa, Homo sapiens
CNGDNDCGDFSDEDDCESEPRPPCR

SEQ ID NO: 67595 - protein, 9 aa, Homo sapiens
CTDAVGDRR

SEQ ID NO: 67596 - protein, 9 aa, Homo sapiens
DGNTLTYYR

SEQ ID NO: 67597 - protein, 11 aa, Homo sapiens
DRDGNTLTYYR

SEQ ID NO: 67598 - protein, 11 aa, Homo sapiens
DRVVEESELAR

SEQ ID NO: 67599 - protein, 13 aa, Homo sapiens
DVVLTTTFVDDIK

SEQ ID NO: 67600 - protein, 10 aa, Homo sapiens
FEGIACEISK

SEQ ID NO: 67601 - protein, 18 aa, Homo sapiens
FSYSKNETYQLFLSYSSK

SEQ ID NO: 67602 - protein, 19 aa, Homo sapiens
FSYSKNETYQLFLSYSSKK

SEQ ID NO: 67603 - protein, 8 aa, Homo sapiens
FTPTETNK

SEQ ID NO: 67604 - protein, 25 aa, Homo sapiens
FTPTETNKAEQCCEETASSISLHGK

SEQ ID NO: 67605 - protein, 7 aa, Homo sapiens
GEIHLGR

SEQ ID NO: 67606 - protein, 18 aa, Homo sapiens
GEKNFRTEHYEEQIEAFK

SEQ ID NO: 67607 - protein, 10 aa, Homo sapiens
GEYFAFLETY

SEQ ID NO: 67608 - protein, 13 aa, Homo sapiens
GEYFAFLETYGTH

SEQ ID NO: 67609 - protein, 14 aa, Homo sapiens
GEYFAFLETYGTHY

SEQ ID NO: 67610 - protein, 13 aa, Homo sapiens
GGTRKYAFELKEK

SEQ ID NO: 67611 - protein, 22 aa, Homo sapiens
GTHYSSSGSLGGLYELIYVLDK

SEQ ID NO: 67612 - protein, 26 aa, Homo sapiens
GTVIDVTDFVNWASSINDAPVLISQK

SEQ ID NO: 67613 - protein, 19 aa, Homo sapiens
HLDVSLAFSEISVGAEFNK

SEQ ID NO: 67614 - protein, 13 aa, Homo sapiens
ISEGLPALEFPNE

SEQ ID NO: 67615 - protein, 14 aa, Homo sapiens
ISEGLPALEFPNEK

SEQ ID NO: 67616 - protein, 18 aa, Homo sapiens
KAEQCCEETASSISLHGK

SEQ ID NO: 67617 - protein, 10 aa, Homo sapiens
KGVELKDIKR

SEQ ID NO: 67618 - protein, 15 aa, Homo sapiens
KNETYQLFLSYSSKK

SEQ ID NO: 67619 - protein, 7 aa, Homo sapiens
KYAFELK

SEQ ID NO: 67620 - protein, 9 aa, Homo sapiens
KYAFELKEK

SEQ ID NO: 67621 - protein, 26 aa, Homo sapiens
LETYGTHYSSSGSLGGLYELIYVLDK

SEQ ID NO: 67622 - protein, 10 aa, Homo sapiens
LIDDVVSLIR

SEQ ID NO: 67623 - protein, 11 aa, Homo sapiens
LSPIYNLVPVK

SEQ ID NO: 67624 - protein, 13 aa, Homo sapiens
LSPIYNLVPVKMK

SEQ ID NO: 67625 - protein, 11 aa, Homo sapiens
NAHLKKQNLER

SEQ ID NO: 67626 - protein, 11 aa, Homo sapiens
NLIDDVVSLIR

SEQ ID NO: 67627 - protein, 15 aa, Homo sapiens
NRDVVLTTTFVDDIK

SEQ ID NO: 67628 - protein, 10 aa, Homo sapiens
NVASLIYETK

SEQ ID NO: 67629 - protein, 19 aa, Homo sapiens
PCEDAEDDCGNDFQCSTGR

SEQ ID NO: 67630 - protein, 9 aa, Homo sapiens
PIYNLVPVK

SEQ ID NO: 67631 - protein, 22 aa, Homo sapiens
PTEPCEDAEDDCGNDFQCSTGR

SEQ ID NO: 67632 - protein, 25 aa, Homo sapiens
QCVPTEPCEDAEDDCGNDFQCSTGR

SEQ ID NO: 67633 - protein, 20 aa, Homo sapiens
RAVNITSENLIDDVVSLIRG

SEQ ID NO: 67634 - protein, 13 aa, Homo sapiens
RPWNVASLIYETK

SEQ ID NO: 67635 - protein, 16 aa, Homo sapiens
RPWNVASLIYETKGEK

SEQ ID NO: 67636 - protein, 26 aa, Homo sapiens
RQCVPTEPCEDAEDDCGNDFQCSTGR

SEQ ID NO: 67637 - protein, 16 aa, Homo sapiens
SGSLGGLYELIYVLDK

SEQ ID NO: 67638 - protein, 11 aa, Homo sapiens
SIEVFGQFNGK

SEQ ID NO: 67639 - protein, 12 aa, Homo sapiens
SIEVFGQFNGKR

SEQ ID NO: 67640 - protein, 12 aa, Homo sapiens
SINDAPVLISQK

SEQ ID NO: 67641 - protein, 14 aa, Homo sapiens
SLGGLYELIYVLDK

SEQ ID NO: 67642 - protein, 14 aa, Homo sapiens
SRSIEVFGQFNGKR

SEQ ID NO: 67643 - protein, 17 aa, Homo sapiens
SSGSLGGLYELIYVLDK

SEQ ID NO: 67644 - protein, 13 aa, Homo sapiens
SSINDAPVLISQK

SEQ ID NO: 67645 - protein, 18 aa, Homo sapiens
SSSGSLGGLYELIYVLDK

SEQ ID NO: 67646 - protein, 14 aa, Homo sapiens
TAGYGINILGMDPL

SEQ ID NO: 67647 - protein, 29 aa, Homo sapiens
TAGYGINILGMDPLSTPFDNEFYNGLCNR

SEQ ID NO: 67648 - protein, 12 aa, Homo sapiens
TEHYEEQIEAFK

SEQ ID NO: 67649 - protein, 18 aa, Homo sapiens
TEHYEEQIEAFKSIIQEK

SEQ ID NO: 67650 - protein, 11 aa, Homo sapiens
TSNFNAAISLK

SEQ ID NO: 67651 - protein, 9 aa, Homo sapiens
VASLIYETK

SEQ ID NO: 67652 - protein, 9 aa, Homo sapiens
VVEESELAR

SEQ ID NO: 67653 - protein, 15 aa, Homo sapiens
WASSINDAPVLISQK

SEQ ID NO: 67654 - protein, 11 aa, Homo sapiens
WNVASLIYETK

SEQ ID NO: 67655 - protein, 19 aa, Homo sapiens
YSSSGSLGGLYELIYVLDK

SEQ ID NO: 67656 - protein, 11 aa, Homo sapiens
DQVAALSWVQK

SEQ ID NO: 67657 - protein, 13 aa, Homo sapiens
LPVLVWFPGGAFK

SEQ ID NO: 67658 - protein, 18 aa, Homo sapiens
VVDGAFFPNEPLDLLSQK

SEQ ID NO: 67659 - protein, 14 aa, Homo sapiens
CLDPCVISQEIMEK

SEQ ID NO: 67660 - protein, 11 aa, Homo sapiens
INHGILYDEEK

SEQ ID NO: 67661 - protein, 13 aa, Homo sapiens
ITCAEEGWSPTPK

SEQ ID NO: 67662 - protein, 11 aa, Homo sapiens
LCFFPFVENGH

SEQ ID NO: 67663 - protein, 34 aa, Homo sapiens
LCFFPFVENGHSESSGQTHLEGDTVQIICNTGYR

SEQ ID NO: 67664 - protein, 13 aa, Homo sapiens
LQNNENNISCVER

SEQ ID NO: 67665 - protein, 20 aa, Homo sapiens
LQNNENNISCVERGWSTPPK

SEQ ID NO: 67666 - protein, 9 aa, Homo sapiens
LVYPSCEEK

SEQ ID NO: 67667 - protein, 9 aa, Homo sapiens
NGQWSEPPK

SEQ ID NO: 67668 - protein, 10 aa, Homo sapiens
NHGILYDEEK

SEQ ID NO: 67669 - protein, 12 aa, Homo sapiens
SGYHPTKSHSFR

SEQ ID NO: 67670 - protein, 22 aa, Homo sapiens
SQVPTGEVFYYSCEYNFVSPSK

SEQ ID NO: 67671 - protein, 10 aa, Homo sapiens
TGDIVEFVCK

SEQ ID NO: 67672 - protein, 15 aa, Homo sapiens
YKPFSQVPTGEVFYY

SEQ ID NO: 67673 - protein, 26 aa, Homo sapiens
YKPFSQVPTGEVFYYSCEYNFVSPSK

SEQ ID NO: 67674 - protein, 14 aa, Homo sapiens
CLDPCVVSEENMNK

SEQ ID NO: 67675 - protein, 27 aa, Homo sapiens
EQFCPPPPQIPNAQNMTTTVNYQDGEK

SEQ ID NO: 67676 - protein, 17 aa, Homo sapiens
GECHVPILEANVDAQPK

SEQ ID NO: 67677 - protein, 13 aa, Homo sapiens
ITCTEEGWSPTPK

SEQ ID NO: 67678 - protein, 24 aa, Homo sapiens
KEEYGHNEVVEYDCNPNFIINGPK

SEQ ID NO: 67679 - protein, 8 aa, Homo sapiens
MCSFPFVK

SEQ ID NO: 67680 - protein, 17 aa, Homo sapiens
PNAQNMTTTVNYQDGEK

SEQ ID NO: 67681 - protein, 28 aa, Homo sapiens
REQFCPPPPQIPNAQNMTTTVNYQDGEK

SEQ ID NO: 67682 - protein, 29 aa, Homo sapiens
REQFCPPPPQIPNAQNMTTTVNYQDGEKV

SEQ ID NO: 67683 - protein, 14 aa, Homo sapiens
SCGPPPQLSNGEVK

SEQ ID NO: 67684 - protein, 18 aa, Homo sapiens
ACDGINDCGDQSDELCCK

SEQ ID NO: 67685 - protein, 10 aa, Homo sapiens
ACQGKGFHCK

SEQ ID NO: 67686 - protein, 15 aa, Homo sapiens
ADSPMDDFFQCVNGK

SEQ ID NO: 67687 - protein, 13 aa, Homo sapiens
AQLGDLPWQVAIK

SEQ ID NO: 67688 - protein, 19 aa, Homo sapiens
ASVAQEETEILTADMDAER

SEQ ID NO: 67689 - protein, 9 aa, Homo sapiens
CIEGTCVCK

SEQ ID NO: 67690 - protein, 16 aa, Homo sapiens
CIEGTCVCKLPYQCPK

SEQ ID NO: 67691 - protein, 26 aa, Homo sapiens
CIEGTCVCKLPYQCPKNGTAVCATNR

SEQ ID NO: 67692 - protein, 27 aa, Homo sapiens
CIEGTCVCKLPYQCPKNGTAVCATNRR

SEQ ID NO: 67693 - protein, 19 aa, Homo sapiens
EANVACLDLGFQQGADTQR

SEQ ID NO: 67694 - protein, 20 aa, Homo sapiens
EANVACLDLGFQQGADTQRR

SEQ ID NO: 67695 - protein, 16 aa, Homo sapiens
EKDNERVFSLQWGEVK

SEQ ID NO: 67696 - protein, 16 aa, Homo sapiens
EMECAGTYDGSIDACK

SEQ ID NO: 67697 - protein, 19 aa, Homo sapiens
FKLSDLSINSTECLHVHCR

SEQ ID NO: 67698 - protein, 12 aa, Homo sapiens
FLNNGTCTAEGK

SEQ ID NO: 67699 - protein, 18 aa, Homo sapiens
FLNNGTCTAEGKFSVSLK

SEQ ID NO: 67700 - protein, 19 aa, Homo sapiens
FSVSLKHGNTDSEGIVEVK

SEQ ID NO: 67701 - protein, 20 aa, Homo sapiens
FYEKEMECAGTYDGSIDACK

SEQ ID NO: 67702 - protein, 13 aa, Homo sapiens
GLETSLAECTFTK

SEQ ID NO: 67703 - protein, 14 aa, Homo sapiens
GLETSLAECTFTKR

SEQ ID NO: 67704 - protein, 15 aa, Homo sapiens
GLETSLAECTFTKRR

SEQ ID NO: 67705 - protein, 13 aa, Homo sapiens
HGNTDSEGIVEVK

SEQ ID NO: 67706 - protein, 14 aa, Homo sapiens
IIFHENYNAGTYQN

SEQ ID NO: 67707 - protein, 22 aa, Homo sapiens
IIFHENYNAGTYQNDIALIEMK

SEQ ID NO: 67708 - protein, 8 aa, Homo sapiens
IVIEYVDR

SEQ ID NO: 67709 - protein, 14 aa, Homo sapiens
KFLNNGTCTAEGKF

SEQ ID NO: 67710 - protein, 9 aa, Homo sapiens
KLISNCSKF

SEQ ID NO: 67711 - protein, 19 aa, Homo sapiens
KLSDLSINSTECLHVHCRG

SEQ ID NO: 67712 - protein, 12 aa, Homo sapiens
KNGTAVCATNRR

SEQ ID NO: 67713 - protein, 13 aa, Homo sapiens
KVTYTSQEDLVEK

SEQ ID NO: 67714 - protein, 14 aa, Homo sapiens
KVTYTSQEDLVEKK

SEQ ID NO: 67715 - protein, 18 aa, Homo sapiens
KVTYTSQEDLVEKKCLAK

SEQ ID NO: 67716 - protein, 19 aa, Homo sapiens
KVTYTSQEDLVEKKCLAKK

SEQ ID NO: 67717 - protein, 9 aa, Homo sapiens
KYTHLSCDK

SEQ ID NO: 67718 - protein, 17 aa, Homo sapiens
KYTHLSCDKVFCQPWQR

SEQ ID NO: 67719 - protein, 12 aa, Homo sapiens
LISNCSKFYGNR

SEQ ID NO: 67720 - protein, 7 aa, Homo sapiens
LPYQCPK

SEQ ID NO: 67721 - protein, 17 aa, Homo sapiens
LPYQCPKNGTAVCATNR

SEQ ID NO: 67722 - protein, 18 aa, Homo sapiens
LPYQCPKNGTAVCATNRR

SEQ ID NO: 67723 - protein, 17 aa, Homo sapiens
LSDLSINSTECLHVHCR

SEQ ID NO: 67724 - protein, 12 aa, Homo sapiens
LVDQDKTMFICK

SEQ ID NO: 67725 - protein, 10 aa, Homo sapiens
NGTAVCATNR

SEQ ID NO: 67726 - protein, 20 aa, Homo sapiens
NYFDWISYHVGRPFISQYNV

SEQ ID NO: 67727 - protein, 8 aa, Homo sapiens
PFISQYNV

SEQ ID NO: 67728 - protein, 12 aa, Homo sapiens
PNDTCIVSGWGR

SEQ ID NO: 67729 - protein, 20 aa, Homo sapiens
PWSPYLFQPNDTCIVSGWGR

SEQ ID NO: 67730 - protein, 17 aa, Homo sapiens
PYLFQPNDTCIVSGWGR

SEQ ID NO: 67731 - protein, 14 aa, Homo sapiens
RAQLGDLPWQVAIK

SEQ ID NO: 67732 - protein, 9 aa, Homo sapiens
RIVIEYVDR

SEQ ID NO: 67733 - protein, 10 aa, Homo sapiens
RSFPTYCQQK

SEQ ID NO: 67734 - protein, 28 aa, Homo sapiens
RSIPACVPWSPYLFQPNDTCIVSGWGRE

SEQ ID NO: 67735 - protein, 16 aa, Homo sapiens
SDLSINSTECLHVHCR

SEQ ID NO: 67736 - protein, 9 aa, Homo sapiens
SFPTYCQQK

SEQ ID NO: 67737 - protein, 13 aa, Homo sapiens
SINSTECLHVHCR

SEQ ID NO: 67738 - protein, 26 aa, Homo sapiens
SIPACVPWSPYLFQPNDTCIVSGWGR

SEQ ID NO: 67739 - protein, 10 aa, Homo sapiens
SLECLHPGTK

SEQ ID NO: 67740 - protein, 22 aa, Homo sapiens
SLECLHPGTKFLNNGTCTAEGK

SEQ ID NO: 67741 - protein, 6 aa, Homo sapiens
TMFICK

SEQ ID NO: 67742 - protein, 16 aa, Homo sapiens
TMGYQDFADVVCYTQK

SEQ ID NO: 67743 - protein, 17 aa, Homo sapiens
TMGYQDFADVVCYTQKA

SEQ ID NO: 67744 - protein, 12 aa, Homo sapiens
TTVVDWIHPDLK

SEQ ID NO: 67745 - protein, 11 aa, Homo sapiens
TVVDWIHPDLK

SEQ ID NO: 67746 - protein, 12 aa, Homo sapiens
TYQNDIALIEMK

SEQ ID NO: 67747 - protein, 11 aa, Homo sapiens
TYTSQEDLVEK

SEQ ID NO: 67748 - protein, 10 aa, Homo sapiens
VANYFDWISY

SEQ ID NO: 67749 - protein, 14 aa, Homo sapiens
VANYFDWISYHVGR

SEQ ID NO: 67750 - protein, 16 aa, Homo sapiens
VANYFDWISYHVGRPF

SEQ ID NO: 67751 - protein, 22 aa, Homo sapiens
VANYFDWISYHVGRPFISQYNV

SEQ ID NO: 67752 - protein, 8 aa, Homo sapiens
VFCQPWQR

SEQ ID NO: 67753 - protein, 10 aa, Homo sapiens
VFSLQWGEVK

SEQ ID NO: 67754 - protein, 12 aa, Homo sapiens
VTYTSQEDLVEK

SEQ ID NO: 67755 - protein, 6 aa, Homo sapiens
YISQMK

SEQ ID NO: 67756 - protein, 24 aa, Homo sapiens
YISQMKACDGINDCGDQSDELCCK

SEQ ID NO: 67757 - protein, 16 aa, Homo sapiens
YQIWTTVVDWIHPDLK

SEQ ID NO: 67758 - protein, 17 aa, Homo sapiens
YQIWTTVVDWIHPDLKR

SEQ ID NO: 67759 - protein, 8 aa, Homo sapiens
YTHLSCDK

SEQ ID NO: 67760 - protein, 16 aa, Homo sapiens
YTHLSCDKVFCQPWQR

SEQ ID NO: 67761 - protein, 17 aa, Homo sapiens
KLRWDPADYENVTSIRI

SEQ ID NO: 67762 - protein, 11 aa, Homo sapiens
FVGQLDISIAR

SEQ ID NO: 67763 - protein, 9 aa, Homo sapiens
FYYIVQEEK

SEQ ID NO: 67764 - protein, 10 aa, Homo sapiens
VFIGVNDLER

SEQ ID NO: 67765 - protein, 12 aa, Homo sapiens
AAFFHGQALTNK

SEQ ID NO: 67766 - protein, 13 aa, Homo sapiens
ADDKVYPGEQYTY

SEQ ID NO: 67767 - protein, 21 aa, Homo sapiens
ADDKVYPGEQYTYMLLATEEQ

SEQ ID NO: 67768 - protein, 33 aa, Homo sapiens
ADDKVYPGEQYTYMLLATEEQSPGEGDGNCVTR

SEQ ID NO: 67769 - protein, 14 aa, Homo sapiens
AEEEHLGILGPQLH

SEQ ID NO: 67770 - protein, 16 aa, Homo sapiens
AEEEHLGILGPQLHAD

SEQ ID NO: 67771 - protein, 20 aa, Homo sapiens
AEEEHLGILGPQLHADVGDK

SEQ ID NO: 67772 - protein, 22 aa, Homo sapiens
AEEEHLGILGPQLHADVGDKVK

SEQ ID NO: 67773 - protein, 12 aa, Homo sapiens
AETGDKVYVHLK

SEQ ID NO: 67774 - protein, 11 aa, Homo sapiens
AFFHGQALTNK

SEQ ID NO: 67775 - protein, 13 aa, Homo sapiens
AFLDKGEFYIGSK

SEQ ID NO: 67776 - protein, 14 aa, Homo sapiens
AGLQAFFQVQECNK

SEQ ID NO: 67777 - protein, 18 aa, Homo sapiens
AGLQAFFQVQECNKSSSK

SEQ ID NO: 67778 - protein, 22 aa, Homo sapiens
AGLQAFFQVQECNKSSSKDNIR

SEQ ID NO: 67779 - protein, 16 aa, Homo sapiens
AGMETTYTVLQNEDTK

SEQ ID NO: 67780 - protein, 25 aa, Homo sapiens
AHGVQTESSTVTPTLPGETLTYVWK

SEQ ID NO: 67781 - protein, 12 aa, Homo sapiens
ALYLQYTDETFR

SEQ ID NO: 67782 - protein, 16 aa, Homo sapiens
APGSDSAVFFEQGTTR

SEQ ID NO: 67783 - protein, 10 aa, Homo sapiens
APSGIDIFTK

SEQ ID NO: 67784 - protein, 18 aa, Homo sapiens
AQNPGEWMLSCQNLNHLK

SEQ ID NO: 67785 - protein, 16 aa, Homo sapiens
ASRPYTFHSHGITYYK

SEQ ID NO: 67786 - protein, 12 aa, Homo sapiens
AVEVEWDYSPQR

SEQ ID NO: 67787 - protein, 10 aa, Homo sapiens
AYYSTVDQVK

SEQ ID NO: 67788 - protein, 10 aa, Homo sapiens
DDEEFIESNK

SEQ ID NO: 67789 - protein, 14 aa, Homo sapiens
DIASGLIGPLIICK

SEQ ID NO: 67790 - protein, 15 aa, Homo sapiens
DIASGLIGPLIICKK

SEQ ID NO: 67791 - protein, 15 aa, Homo sapiens
DIFPGTYQTLEMFPR

SEQ ID NO: 67792 - protein, 11 aa, Homo sapiens
DIFTGLIGPMK

SEQ ID NO: 67793 - protein, 14 aa, Homo sapiens
DLYSGLIGPLIVCR

SEQ ID NO: 67794 - protein, 10 aa, Homo sapiens
DNEDFQESNR

SEQ ID NO: 67795 - protein, 8 aa, Homo sapiens
DNTTDFQR

SEQ ID NO: 67796 - protein, 9 aa, Homo sapiens
DSLDKEKEK

SEQ ID NO: 67797 - protein, 11 aa, Homo sapiens
DTANLFPQTSL

SEQ ID NO: 67798 - protein, 14 aa, Homo sapiens
DTANLFPQTSLTLH

SEQ ID NO: 67799 - protein, 21 aa, Homo sapiens
DTANLFPQTSLTLHMWPDTEG

SEQ ID NO: 67800 - protein, 26 aa, Homo sapiens
DVDKEFYLFPTVFDENESLLLEDNIR

SEQ ID NO: 67801 - protein, 17 aa, Homo sapiens
EADVHGIYFSGNTYLWR

SEQ ID NO: 67802 - protein, 10 aa, Homo sapiens
EDEDFQESNK

SEQ ID NO: 67803 - protein, 22 aa, Homo sapiens
EFVVMFSVVDENFSWYLEDNIK

SEQ ID NO: 67804 - protein, 22 aa, Homo sapiens
EFYLFPTVFDENESLLLEDNIR

SEQ ID NO: 67805 - protein, 14 aa, Homo sapiens
EGAIYPDNTTDFQR

SEQ ID NO: 67806 - protein, 13 aa, Homo sapiens
EHEGAIYPDNTTD

SEQ ID NO: 67807 - protein, 16 aa, Homo sapiens
EHEGAIYPDNTTDFQR

SEQ ID NO: 67808 - protein, 20 aa, Homo sapiens
EHEGAIYPDNTTDFQRADDK

SEQ ID NO: 67809 - protein, 17 aa, Homo sapiens
EIDLHTVHFHGHSFQYK

SEQ ID NO: 67810 - protein, 16 aa, Homo sapiens
ELHHLQEQNVSNAFLD

SEQ ID NO: 67811 - protein, 17 aa, Homo sapiens
ELHHLQEQNVSNAFLDK

SEQ ID NO: 67812 - protein, 20 aa, Homo sapiens
ELHHLQEQNVSNAFLDKGEF

SEQ ID NO: 67813 - protein, 21 aa, Homo sapiens
ELHHLQEQNVSNAFLDKGEFY

SEQ ID NO: 67814 - protein, 25 aa, Homo sapiens
ELHHLQEQNVSNAFLDKGEFYIGSK

SEQ ID NO: 67815 - protein, 12 aa, Homo sapiens
ENFSWYLEDNIK

SEQ ID NO: 67816 - protein, 20 aa, Homo sapiens
ENLTAPGSDSAVFFEQGTTR

SEQ ID NO: 67817 - protein, 25 aa, Homo sapiens
ERGPEEEHLGILGPVIWAEVGDTIR

SEQ ID NO: 67818 - protein, 13 aa, Homo sapiens
ETTYTVLQNEDTK

SEQ ID NO: 67819 - protein, 17 aa, Homo sapiens
EVDVHAAFFHGQALTNK

SEQ ID NO: 67820 - protein, 14 aa, Homo sapiens
EVGPTNADPVCLAK

SEQ ID NO: 67821 - protein, 21 aa, Homo sapiens
EWEKELHHLQEQNVSNAFLDK

SEQ ID NO: 67822 - protein, 29 aa, Homo sapiens
EWEKELHHLQEQNVSNAFLDKGEFYIGSK

SEQ ID NO: 67823 - protein, 10 aa, Homo sapiens
EYTDASFTNR

SEQ ID NO: 67824 - protein, 11 aa, Homo sapiens
EYTDASFTNRK

SEQ ID NO: 67825 - protein, 10 aa, Homo sapiens
FFHGQALTNK

SEQ ID NO: 67826 - protein, 9 aa, Homo sapiens
FHGQALTNK

SEQ ID NO: 67827 - protein, 12 aa, Homo sapiens
FLDKGEFYIGSK

SEQ ID NO: 67828 - protein, 17 aa, Homo sapiens
FLVFDENESWYLDDNIK

SEQ ID NO: 67829 - protein, 13 aa, Homo sapiens
FNKNNEGTYYSPN

SEQ ID NO: 67830 - protein, 19 aa, Homo sapiens
FNKNNEGTYYSPNYNPQSR

SEQ ID NO: 67831 - protein, 29 aa, Homo sapiens
FPATLFDAYMVAQNPGEWMLSCQNLNHLK

SEQ ID NO: 67832 - protein, 33 aa, Homo sapiens
FPQTSLTLHMWPDTEGTFNVECLTTDHYTGGMK

SEQ ID NO: 67833 - protein, 18 aa, Homo sapiens
FPTVFDENESLLLEDNIR

SEQ ID NO: 67834 - protein, 9 aa, Homo sapiens
FSGNTYLWR

SEQ ID NO: 67835 - protein, 17 aa, Homo sapiens
FSVVDENFSWYLEDNIK

SEQ ID NO: 67836 - protein, 10 aa, Homo sapiens
FSWYLEDNIK

SEQ ID NO: 67837 - protein, 13 aa, Homo sapiens
GAIYPDNTTDFQR

SEQ ID NO: 67838 - protein, 13 aa, Homo sapiens
GAYPLSIEPIGVR

SEQ ID NO: 67839 - protein, 32 aa, Homo sapiens
GAYPLSIEPIGVRFNKNNEGTYYSPNYNPQSR

SEQ ID NO: 67840 - protein, 18 aa, Homo sapiens
GDSVVWYLFSAGNEADVH

SEQ ID NO: 67841 - protein, 22 aa, Homo sapiens
GDSVVWYLFSAGNEADVHGIYF

SEQ ID NO: 67842 - protein, 25 aa, Homo sapiens
GDSVVWYLFSAGNEADVHGIYFSGN

SEQ ID NO: 67843 - protein, 30 aa, Homo sapiens
GDSVVWYLFSAGNEADVHGIYFSGNTYLWR

SEQ ID NO: 67844 - protein, 8 aa, Homo sapiens
GEFYIGSK

SEQ ID NO: 67845 - protein, 16 aa, Homo sapiens
GILGPVIWAEVGDTIR

SEQ ID NO: 67846 - protein, 22 aa, Homo sapiens
GITYYKEHEGAIYPDNTTDFQR

SEQ ID NO: 67847 - protein, 12 aa, Homo sapiens
GIYFSGNTYLWR

SEQ ID NO: 67848 - protein, 21 aa, Homo sapiens
GMGNEVDVHAAFFHGQALTNK

SEQ ID NO: 67849 - protein, 19 aa, Homo sapiens
GNEIDLHTVHFHGHSFQYK

SEQ ID NO: 67850 - protein, 19 aa, Homo sapiens
GNEVDVHAAFFHGQALTNK

SEQ ID NO: 67851 - protein, 23 aa, Homo sapiens
GPEEEHLGILGPVIWAEVGDTIR

SEQ ID NO: 67852 - protein, 7 aa, Homo sapiens
GPLIICK

SEQ ID NO: 67853 - protein, 7 aa, Homo sapiens
GPLIVCR

SEQ ID NO: 67854 - protein, 11 aa, Homo sapiens
GPQLHADVGDK

SEQ ID NO: 67855 - protein, 12 aa, Homo sapiens
GPTNADPVCLAK

SEQ ID NO: 67856 - protein, 13 aa, Homo sapiens
GPVIWAEVGDTIR

SEQ ID NO: 67857 - protein, 14 aa, Homo sapiens
GSDSAVFFEQGTTR

SEQ ID NO: 67858 - protein, 8 aa, Homo sapiens
GSLHANGR

SEQ ID NO: 67859 - protein, 23 aa, Homo sapiens
GVQTESSTVTPTLPGETLTYVWK

SEQ ID NO: 67860 - protein, 15 aa, Homo sapiens
GVYSSDVFDIFPGTY

SEQ ID NO: 67861 - protein, 16 aa, Homo sapiens
GVYSSDVFDIFPGTYQ

SEQ ID NO: 67862 - protein, 18 aa, Homo sapiens
GVYSSDVFDIFPGTYQTL

SEQ ID NO: 67863 - protein, 23 aa, Homo sapiens
GVYSSDVFDIFPGTYQTLEMFPR

SEQ ID NO: 67864 - protein, 15 aa, Homo sapiens
HEGAIYPDNTTDFQR

SEQ ID NO: 67865 - protein, 8 aa, Homo sapiens
HGQALTNK

SEQ ID NO: 67866 - protein, 15 aa, Homo sapiens
HHLQEQNVSNAFLDK

SEQ ID NO: 67867 - protein, 23 aa, Homo sapiens
HHLQEQNVSNAFLDKGEFYIGSK

SEQ ID NO: 67868 - protein, 26 aa, Homo sapiens
HIDREFVVMFSVVDENFSWYLEDNIK

SEQ ID NO: 67869 - protein, 14 aa, Homo sapiens
HLQEQNVSNAFLDK

SEQ ID NO: 67870 - protein, 22 aa, Homo sapiens
HLQEQNVSNAFLDKGEFYIGSK

SEQ ID NO: 67871 - protein, 25 aa, Homo sapiens
HRGVYSSDVFDIFPGTYQTLEMFPR

SEQ ID NO: 67872 - protein, 25 aa, Homo sapiens
HSHGITYYKEHEGAIYPDNTTDFQR

SEQ ID NO: 67873 - protein, 8 aa, Homo sapiens
HSHIDAPK

SEQ ID NO: 67874 - protein, 12 aa, Homo sapiens
HSNIYLQNGPDR

SEQ ID NO: 67875 - protein, 23 aa, Homo sapiens
HVTDHIHAGMETTYTVLQNEDTK

SEQ ID NO: 67876 - protein, 12 aa, Homo sapiens
HYYIAAEEIIWN

SEQ ID NO: 67877 - protein, 16 aa, Homo sapiens
HYYIAAEEIIWNYAPS

SEQ ID NO: 67878 - protein, 21 aa, Homo sapiens
HYYIAAEEIIWNYAPSGIDIF

SEQ ID NO: 67879 - protein, 23 aa, Homo sapiens
HYYIAAEEIIWNYAPSGIDIFTK

SEQ ID NO: 67880 - protein, 20 aa, Homo sapiens
HYYIGIIETTWDYASDHGEK

SEQ ID NO: 67881 - protein, 21 aa, Homo sapiens
HYYIGIIETTWDYASDHGEKK

SEQ ID NO: 67882 - protein, 20 aa, Homo sapiens
IAAEEIIWNYAPSGIDIFTK

SEQ ID NO: 67883 - protein, 14 aa, Homo sapiens
IAAVEVEWDYSPQR

SEQ ID NO: 67884 - protein, 12 aa, Homo sapiens
IDTINLFPATLF

SEQ ID NO: 67885 - protein, 15 aa, Homo sapiens
IDTINLFPATLFDAY

SEQ ID NO: 67886 - protein, 35 aa, Homo sapiens
IDTINLFPATLFDAYMVAQNPGEWMLSCQNLNHLK

SEQ ID NO: 67887 - protein, 15 aa, Homo sapiens
IEKPVWLGFLGPIIK

SEQ ID NO: 67888 - protein, 6 aa, Homo sapiens
IGGSYK

SEQ ID NO: 67889 - protein, 21 aa, Homo sapiens
IGGSYKKLVYREYTDASFTNR

SEQ ID NO: 67890 - protein, 22 aa, Homo sapiens
IGGSYKKLVYREYTDASFTNRK

SEQ ID NO: 67891 - protein, 17 aa, Homo sapiens
IGIIETTWDYASDHGEK

SEQ ID NO: 67892 - protein, 10 aa, Homo sapiens
IYHSHIDAPK

SEQ ID NO: 67893 - protein, 24 aa, Homo sapiens
IYHSHIDAPKDIASGLIGPLIICK

SEQ ID NO: 67894 - protein, 25 aa, Homo sapiens
IYHSHIDAPKDIASGLIGPLIICKK

SEQ ID NO: 67895 - protein, 9 aa, Homo sapiens
IYLQNGPDR

SEQ ID NO: 67896 - protein, 11 aa, Homo sapiens
IYPDNTTDFQR

SEQ ID NO: 67897 - protein, 15 aa, Homo sapiens
KAEEEHLGILGPQLH

SEQ ID NO: 67898 - protein, 16 aa, Homo sapiens
KAEEEHLGILGPQLHA

SEQ ID NO: 67899 - protein, 17 aa, Homo sapiens
KAEEEHLGILGPQLHAD

SEQ ID NO: 67900 - protein, 19 aa, Homo sapiens
KAEEEHLGILGPQLHADVG

SEQ ID NO: 67901 - protein, 21 aa, Homo sapiens
KAEEEHLGILGPQLHADVGDK

SEQ ID NO: 67902 - protein, 23 aa, Homo sapiens
KAEEEHLGILGPQLHADVGDKVK

SEQ ID NO: 67903 - protein, 16 aa, Homo sapiens
KAGLQAFFQVQECNKS

SEQ ID NO: 67904 - protein, 13 aa, Homo sapiens
KALYLQYTDETFR

SEQ ID NO: 67905 - protein, 28 aa, Homo sapiens
KDVDKEFYLFPTVFDENESLLLEDNIRM

SEQ ID NO: 67906 - protein, 17 aa, Homo sapiens
KEHEGAIYPDNTTDFQR

SEQ ID NO: 67907 - protein, 18 aa, Homo sapiens
KEHEGAIYPDNTTDFQRA

SEQ ID NO: 67908 - protein, 23 aa, Homo sapiens
KEKHYYIGIIETTWDYASDHGEK

SEQ ID NO: 67909 - protein, 24 aa, Homo sapiens
KEKHYYIGIIETTWDYASDHGEKK

SEQ ID NO: 67910 - protein, 19 aa, Homo sapiens
KELHHLQEQNVSNAFLDKG

SEQ ID NO: 67911 - protein, 22 aa, Homo sapiens
KENLTAPGSDSAVFFEQGTTRI

SEQ ID NO: 67912 - protein, 26 aa, Homo sapiens
KERGPEEEHLGILGPVIWAEVGDTIR

SEQ ID NO: 67913 - protein, 9 aa, Homo sapiens
KGSLHANGR

SEQ ID NO: 67914 - protein, 17 aa, Homo sapiens
KIPERSGAGTEDSACIP

SEQ ID NO: 67915 - protein, 8 aa, Homo sapiens
KLEFALLF

SEQ ID NO: 67916 - protein, 24 aa, Homo sapiens
KLEFALLFLVFDENESWYLDDNIK

SEQ ID NO: 67917 - protein, 25 aa, Homo sapiens
KLEFALLFLVFDENESWYLDDNIKT

SEQ ID NO: 67918 - protein, 20 aa, Homo sapiens
KLISVDTEHSNIYLQNGPDR

SEQ ID NO: 67919 - protein, 16 aa, Homo sapiens
KLVYREYTDASFTNRK

SEQ ID NO: 67920 - protein, 17 aa, Homo sapiens
LASRPYTFHSHGITYYK

SEQ ID NO: 67921 - protein, 18 aa, Homo sapiens
LATEEQSPGEGDGNCVTR

SEQ ID NO: 67922 - protein, 11 aa, Homo sapiens
LDKGEFYIGSK

SEQ ID NO: 67923 - protein, 19 aa, Homo sapiens
LFPTVFDENESLLLEDNIR

SEQ ID NO: 67924 - protein, 23 aa, Homo sapiens
LFSAGNEADVHGIYFSGNTYLWR

SEQ ID NO: 67925 - protein, 24 aa, Homo sapiens
LHHLQEQNVSNAFLDKGEFYIGSK

SEQ ID NO: 67926 - protein, 10 aa, Homo sapiens
LISVDTEHSN

SEQ ID NO: 67927 - protein, 12 aa, Homo sapiens
LISVDTEHSNIY

SEQ ID NO: 67928 - protein, 15 aa, Homo sapiens
LISVDTEHSNIYLQN

SEQ ID NO: 67929 - protein, 19 aa, Homo sapiens
LISVDTEHSNIYLQNGPDR

SEQ ID NO: 67930 - protein, 22 aa, Homo sapiens
LISVDTEHSNIYLQNGPDRIGR

SEQ ID NO: 67931 - protein, 27 aa, Homo sapiens
LLHCHVTDHIHAGMETTYTVLQNEDTK

SEQ ID NO: 67932 - protein, 18 aa, Homo sapiens
LTAPGSDSAVFFEQGTTR

SEQ ID NO: 67933 - protein, 16 aa, Homo sapiens
LVFDENESWYLDDNIK

SEQ ID NO: 67934 - protein, 14 aa, Homo sapiens
LVYREYTDASFTNR

SEQ ID NO: 67935 - protein, 15 aa, Homo sapiens
LVYREYTDASFTNRK

SEQ ID NO: 67936 - protein, 17 aa, Homo sapiens
LVYREYTDASFTNRKER

SEQ ID NO: 67937 - protein, 14 aa, Homo sapiens
METTYTVLQNEDTK

SEQ ID NO: 67938 - protein, 11 aa, Homo sapiens
MFGNLQGLTMH

SEQ ID NO: 67939 - protein, 13 aa, Homo sapiens
MFGNLQGLTMHVG

SEQ ID NO: 67940 - protein, 11 aa, Homo sapiens
MFTTAPDQVDK

SEQ ID NO: 67941 - protein, 20 aa, Homo sapiens
MFTTAPDQVDKEDEDFQESN

SEQ ID NO: 67942 - protein, 21 aa, Homo sapiens
MFTTAPDQVDKEDEDFQESNK

SEQ ID NO: 67943 - protein, 7 aa, Homo sapiens
MHAINGR

SEQ ID NO: 67944 - protein, 19 aa, Homo sapiens
MHSMNGFMYGNQPGLTMCK

SEQ ID NO: 67945 - protein, 20 aa, Homo sapiens
MLLATEEQSPGEGDGNCVTR

SEQ ID NO: 67946 - protein, 20 aa, Homo sapiens
MVAQNPGEWMLSCQNLNHLK

SEQ ID NO: 67947 - protein, 22 aa, Homo sapiens
MYSVNGYTFGSLPGLSMCAEDR

SEQ ID NO: 67948 - protein, 24 aa, Homo sapiens
MYSVNGYTFGSLPGLSMCAEDRVK

SEQ ID NO: 67949 - protein, 10 aa, Homo sapiens
MYYSAVDPTK

SEQ ID NO: 67950 - protein, 21 aa, Homo sapiens
MYYSAVDPTKDIFTGLIGPMK

SEQ ID NO: 67951 - protein, 24 aa, Homo sapiens
MYYSAVDPTKDIFTGLIGPMKICK

SEQ ID NO: 67952 - protein, 25 aa, Homo sapiens
MYYSAVDPTKDIFTGLIGPMKICKK

SEQ ID NO: 67953 - protein, 14 aa, Homo sapiens
NAFLDKGEFYIGSK

SEQ ID NO: 67954 - protein, 15 aa, Homo sapiens
NEGTYYSPNYNPQSR

SEQ ID NO: 67955 - protein, 12 aa, Homo sapiens
NKDDEEFIESNK

SEQ ID NO: 67956 - protein, 9 aa, Homo sapiens
NLASRPYTF

SEQ ID NO: 67957 - protein, 10 aa, Homo sapiens
NLASRPYTFH

SEQ ID NO: 67958 - protein, 16 aa, Homo sapiens
NLASRPYTFHSHGITY

SEQ ID NO: 67959 - protein, 18 aa, Homo sapiens
NLASRPYTFHSHGITYYK

SEQ ID NO: 67960 - protein, 34 aa, Homo sapiens
NLASRPYTFHSHGITYYKEHEGAIYPDNTTDFQR

SEQ ID NO: 67961 - protein, 35 aa, Homo sapiens
NMATRPYSIHAHGVQTESSTVTPTLPGETLTYVWK

SEQ ID NO: 67962 - protein, 16 aa, Homo sapiens
NNEGTYYSPNYNPQSR

SEQ ID NO: 67963 - protein, 17 aa, Homo sapiens
NNEGTYYSPNYNPQSRS

SEQ ID NO: 67964 - protein, 9 aa, Homo sapiens
NVSNAFLDK

SEQ ID NO: 67965 - protein, 17 aa, Homo sapiens
NVSNAFLDKGEFYIGSK

SEQ ID NO: 67966 - protein, 28 aa, Homo sapiens
PATLFDAYMVAQNPGEWMLSCQNLNHLK

SEQ ID NO: 67967 - protein, 9 aa, Homo sapiens
PDNTTDFQR

SEQ ID NO: 67968 - protein, 16 aa, Homo sapiens
PDQVDKEDEDFQESNK

SEQ ID NO: 67969 - protein, 15 aa, Homo sapiens
PGSDSAVFFEQGTTR

SEQ ID NO: 67970 - protein, 12 aa, Homo sapiens
PGTYQTLEMFPR

SEQ ID NO: 67971 - protein, 17 aa, Homo sapiens
PKEVGPTNADPVCLAKM

SEQ ID NO: 67972 - protein, 10 aa, Homo sapiens
PLSIEPIGVR

SEQ ID NO: 67973 - protein, 21 aa, Homo sapiens
PPSASHVAPTETFTYEWTVPK

SEQ ID NO: 67974 - protein, 35 aa, Homo sapiens
PPSASHVAPTETFTYEWTVPKEVGPTNADPVCLAK

SEQ ID NO: 67975 - protein, 32 aa, Homo sapiens
PQTSLTLHMWPDTEGTFNVECLTTDHYTGGMK

SEQ ID NO: 67976 - protein, 14 aa, Homo sapiens
PTKDIFTGLIGPMK

SEQ ID NO: 67977 - protein, 17 aa, Homo sapiens
PTVFDENESLLLEDNIR

SEQ ID NO: 67978 - protein, 12 aa, Homo sapiens
PVIWAEVGDTIR

SEQ ID NO: 67979 - protein, 12 aa, Homo sapiens
PVWLGFLGPIIK

SEQ ID NO: 67980 - protein, 12 aa, Homo sapiens
PWAYYSTVDQVK

SEQ ID NO: 67981 - protein, 30 aa, Homo sapiens
PYSIHAHGVQTESSTVTPTLPGETLTYVWK

SEQ ID NO: 67982 - protein, 13 aa, Homo sapiens
PYTFHSHGITYYK

SEQ ID NO: 67983 - protein, 29 aa, Homo sapiens
PYTFHSHGITYYKEHEGAIYPDNTTDFQR

SEQ ID NO: 67984 - protein, 28 aa, Homo sapiens
QKDVDKEFYLFPTVFDENESLLLEDNIR

SEQ ID NO: 67985 - protein, 12 aa, Homo sapiens
QSEDSTFYLGER

SEQ ID NO: 67986 - protein, 8 aa, Homo sapiens
QYTDSTFR

SEQ ID NO: 67987 - protein, 13 aa, Homo sapiens
QYTDSTFRVPVER

SEQ ID NO: 67988 - protein, 15 aa, Homo sapiens
RDTANLFPQTSLTLH

SEQ ID NO: 67989 - protein, 24 aa, Homo sapiens
REFVVMFSVVDENFSWYLEDNIKT

SEQ ID NO: 67990 - protein, 25 aa, Homo sapiens
RKLEFALLFLVFDENESWYLDDNIK

SEQ ID NO: 67991 - protein, 13 aa, Homo sapiens
RQSEDSTFYLGER

SEQ ID NO: 67992 - protein, 27 aa, Homo sapiens
RRKLEFALLFLVFDENESWYLDDNIKT

SEQ ID NO: 67993 - protein, 21 aa, Homo sapiens
SAGNEADVHGIYFSGNTYLWR

SEQ ID NO: 67994 - protein, 21 aa, Homo sapiens
SAVDPTKDIFTGLIGPMKICK

SEQ ID NO: 67995 - protein, 11 aa, Homo sapiens
SAVFFEQGTTR

SEQ ID NO: 67996 - protein, 13 aa, Homo sapiens
SDSAVFFEQGTTR

SEQ ID NO: 67997 - protein, 11 aa, Homo sapiens
SEDSTFYLGER

SEQ ID NO: 67998 - protein, 23 aa, Homo sapiens
SGAGTEDSACIPWAYYSTVDQVK

SEQ ID NO: 67999 - protein, 8 aa, Homo sapiens
SGNTYLWR

SEQ ID NO: 68000 - protein, 8 aa, Homo sapiens
SHGITYYK

SEQ ID NO: 68001 - protein, 24 aa, Homo sapiens
SHGITYYKEHEGAIYPDNTTDFQR

SEQ ID NO: 68002 - protein, 17 aa, Homo sapiens
SHVAPTETFTYEWTVPK

SEQ ID NO: 68003 - protein, 28 aa, Homo sapiens
SIHAHGVQTESSTVTPTLPGETLTYVWK

SEQ ID NO: 68004 - protein, 15 aa, Homo sapiens
SNAFLDKGEFYIGSK

SEQ ID NO: 68005 - protein, 11 aa, Homo sapiens
SNIYLQNGPDR

SEQ ID NO: 68006 - protein, 15 aa, Homo sapiens
SRPYTFHSHGITYYK

SEQ ID NO: 68007 - protein, 20 aa, Homo sapiens
SSDVFDIFPGTYQTLEMFPR

SEQ ID NO: 68008 - protein, 18 aa, Homo sapiens
SSTVTPTLPGETLTYVWK

SEQ ID NO: 68009 - protein, 17 aa, Homo sapiens
STVTPTLPGETLTYVWK

SEQ ID NO: 68010 - protein, 17 aa, Homo sapiens
SVDTEHSNIYLQNGPDR

SEQ ID NO: 68011 - protein, 17 aa, Homo sapiens
SVPPSASHVAPTETFTY

SEQ ID NO: 68012 - protein, 23 aa, Homo sapiens
SVPPSASHVAPTETFTYEWTVPK

SEQ ID NO: 68013 - protein, 37 aa, Homo sapiens
SVPPSASHVAPTETFTYEWTVPKEVGPTNADPVCLAK

SEQ ID NO: 68014 - protein, 16 aa, Homo sapiens
SVVDENFSWYLEDNIK

SEQ ID NO: 68015 - protein, 17 aa, Homo sapiens
TAPGSDSAVFFEQGTTR

SEQ ID NO: 68016 - protein, 11 aa, Homo sapiens
TFHSHGITYYK

SEQ ID NO: 68017 - protein, 27 aa, Homo sapiens
TFHSHGITYYKEHEGAIYPDNTTDFQR

SEQ ID NO: 68018 - protein, 17 aa, Homo sapiens
TFNVECLTTDHYTGGMK

SEQ ID NO: 68019 - protein, 16 aa, Homo sapiens
TIEKPVWLGFLGPIIK

SEQ ID NO: 68020 - protein, 22 aa, Homo sapiens
TKENLTAPGSDSAVFFEQGTTR

SEQ ID NO: 68021 - protein, 27 aa, Homo sapiens
TLHMWPDTEGTFNVECLTTDHYTGGMK

SEQ ID NO: 68022 - protein, 8 aa, Homo sapiens
TPGIWLLH

SEQ ID NO: 68023 - protein, 32 aa, Homo sapiens
TPGIWLLHCHVTDHIHAGMETTYTVLQNEDTK

SEQ ID NO: 68024 - protein, 14 aa, Homo sapiens
TPTLPGETLTYVWK

SEQ ID NO: 68025 - protein, 19 aa, Homo sapiens
TTAPDQVDKEDEDFQESNK

SEQ ID NO: 68026 - protein, 11 aa, Homo sapiens
TTIEKPVWLGF

SEQ ID NO: 68027 - protein, 17 aa, Homo sapiens
TTIEKPVWLGFLGPIIK

SEQ ID NO: 68028 - protein, 12 aa, Homo sapiens
TVHFHGHSFQYK

SEQ ID NO: 68029 - protein, 16 aa, Homo sapiens
TVTPTLPGETLTYVWK

SEQ ID NO: 68030 - protein, 8 aa, Homo sapiens
TYCSEPEK

SEQ ID NO: 68031 - protein, 11 aa, Homo sapiens
TYCSEPEKVDK

SEQ ID NO: 68032 - protein, 18 aa, Homo sapiens
TYCSEPEKVDKDNEDFQE

SEQ ID NO: 68033 - protein, 21 aa, Homo sapiens
TYCSEPEKVDKDNEDFQESNR

SEQ ID NO: 68034 - protein, 8 aa, Homo sapiens
TYEWTVPK

SEQ ID NO: 68035 - protein, 8 aa, Homo sapiens
TYSDHPEK

SEQ ID NO: 68036 - protein, 21 aa, Homo sapiens
TYSDHPEKVNKDDEEFIESNK

SEQ ID NO: 68037 - protein, 17 aa, Homo sapiens
TYYIAAVEVEWDYSPQR

SEQ ID NO: 68038 - protein, 20 aa, Homo sapiens
TYYKEHEGAIYPDNTTDFQR

SEQ ID NO: 68039 - protein, 12 aa, Homo sapiens
TYYSPNYNPQSR

SEQ ID NO: 68040 - protein, 15 aa, Homo sapiens
VAPTETFTYEWTVPK

SEQ ID NO: 68041 - protein, 13 aa, Homo sapiens
VDKDNEDFQESNR

SEQ ID NO: 68042 - protein, 16 aa, Homo sapiens
VDTEHSNIYLQNGPDR

SEQ ID NO: 68043 - protein, 15 aa, Homo sapiens
VFDENESLLLEDNIR

SEQ ID NO: 68044 - protein, 14 aa, Homo sapiens
VHGIYFSGNTYLWR

SEQ ID NO: 68045 - protein, 12 aa, Homo sapiens
VNKDDEEFIESN

SEQ ID NO: 68046 - protein, 13 aa, Homo sapiens
VNKDDEEFIESNK

SEQ ID NO: 68047 - protein, 8 aa, Homo sapiens
VSNAFLDK

SEQ ID NO: 68048 - protein, 16 aa, Homo sapiens
VSNAFLDKGEFYIGSK

SEQ ID NO: 68049 - protein, 22 aa, Homo sapiens
VTDHIHAGMETTYTVLQNEDTK

SEQ ID NO: 68050 - protein, 6 aa, Homo sapiens
VTFHNK

SEQ ID NO: 68051 - protein, 19 aa, Homo sapiens
VTFHNKGAYPLSIEPIGVR

SEQ ID NO: 68052 - protein, 22 aa, Homo sapiens
VTFHNKGAYPLSIEPIGVRFNK

SEQ ID NO: 68053 - protein, 9 aa, Homo sapiens
VYPGEQYTY

SEQ ID NO: 68054 - protein, 29 aa, Homo sapiens
VYPGEQYTYMLLATEEQSPGEGDGNCVTR

SEQ ID NO: 68055 - protein, 6 aa, Homo sapiens
VYVHLK

SEQ ID NO: 68056 - protein, 13 aa, Homo sapiens
WYLFGMGNEVDVH

SEQ ID NO: 68057 - protein, 15 aa, Homo sapiens
WYLFGMGNEVDVHAA

SEQ ID NO: 68058 - protein, 20 aa, Homo sapiens
WYLFGMGNEVDVHAAFFHGQ

SEQ ID NO: 68059 - protein, 25 aa, Homo sapiens
WYLFGMGNEVDVHAAFFHGQALTNK

SEQ ID NO: 68060 - protein, 11 aa, Homo sapiens
YAPSGIDIFTK

SEQ ID NO: 68061 - protein, 31 aa, Homo sapiens
YAPSGIDIFTKENLTAPGSDSAVFFEQGTTR

SEQ ID NO: 68062 - protein, 9 aa, Homo sapiens
YHSHIDAPK

SEQ ID NO: 68063 - protein, 21 aa, Homo sapiens
YIAAEEIIWNYAPSGIDIFTK

SEQ ID NO: 68064 - protein, 18 aa, Homo sapiens
YIGIIETTWDYASDHGEK

SEQ ID NO: 68065 - protein, 18 aa, Homo sapiens
YKEHEGAIYPDNTTDFQR

SEQ ID NO: 68066 - protein, 7 aa, Homo sapiens
YKKVVYR

SEQ ID NO: 68067 - protein, 20 aa, Homo sapiens
YLFPTVFDENESLLLEDNIR

SEQ ID NO: 68068 - protein, 24 aa, Homo sapiens
YLFSAGNEADVHGIYFSGNTYLWR

SEQ ID NO: 68069 - protein, 10 aa, Homo sapiens
YLQYTDETFR

SEQ ID NO: 68070 - protein, 10 aa, Homo sapiens
YPDNTTDFQR

SEQ ID NO: 68071 - protein, 11 aa, Homo sapiens
YPLSIEPIGVR

SEQ ID NO: 68072 - protein, 8 aa, Homo sapiens
YSAVDPTK

SEQ ID NO: 68073 - protein, 22 aa, Homo sapiens
YSAVDPTKDIFTGLIGPMKICK

SEQ ID NO: 68074 - protein, 8 aa, Homo sapiens
YSTVDQVK

SEQ ID NO: 68075 - protein, 7 aa, Homo sapiens
YTVNQCR

SEQ ID NO: 68076 - protein, 19 aa, Homo sapiens
YYIGIIETTWDYASDHGEK

SEQ ID NO: 68077 - protein, 20 aa, Homo sapiens
YYSAVDPTKDIFTGLIGPMK

SEQ ID NO: 68078 - protein, 25 aa, Homo sapiens
ASASYYEQYHSLNEIYSWIEFITER

SEQ ID NO: 68079 - protein, 7 aa, Homo sapiens
AVASFLR

SEQ ID NO: 68080 - protein, 14 aa, Homo sapiens
DHEELSLVASEAVR

SEQ ID NO: 68081 - protein, 12 aa, Homo sapiens
DTGTYGFLLPER

SEQ ID NO: 68082 - protein, 12 aa, Homo sapiens
FQSGQVLAALPR

SEQ ID NO: 68083 - protein, 7 aa, Homo sapiens
HPDMLTK

SEQ ID NO: 68084 - protein, 16 aa, Homo sapiens
HSLNEIYSWIEFITER

SEQ ID NO: 68085 - protein, 28 aa, Homo sapiens
HWCEEGASSSSCSETYCGLYPESEPEVK

SEQ ID NO: 68086 - protein, 7 aa, Homo sapiens
IAWHVIR

SEQ ID NO: 68087 - protein, 9 aa, Homo sapiens
IHIGSSFEK

SEQ ID NO: 68088 - protein, 16 aa, Homo sapiens
IHIGSSFEKYPLYVLK

SEQ ID NO: 68089 - protein, 35 aa, Homo sapiens
KAHLNVSGIPCSVLLADVEDLIQQQISNDTVSPRA

SEQ ID NO: 68090 - protein, 17 aa, Homo sapiens
KKQVHFFVNASDVDNVK

SEQ ID NO: 68091 - protein, 16 aa, Homo sapiens
KQVHFFVNASDVDNVK

SEQ ID NO: 68092 - protein, 17 aa, Homo sapiens
KQVHFFVNASDVDNVKA

SEQ ID NO: 68093 - protein, 20 aa, Homo sapiens
LVDFYVMPVVNVDGYDYSWK

SEQ ID NO: 68094 - protein, 12 aa, Homo sapiens
NAIWIDCGIHAR

SEQ ID NO: 68095 - protein, 14 aa, Homo sapiens
PGGGDDWIYDLGIK

SEQ ID NO: 68096 - protein, 15 aa, Homo sapiens
QVHFFVNASDVDNVK

SEQ ID NO: 68097 - protein, 29 aa, Homo sapiens
RQVQVLQNLTTTYEIVLWQPVTADLIVKK

SEQ ID NO: 68098 - protein, 15 aa, Homo sapiens
SFYANNHCIGTDLNR

SEQ ID NO: 68099 - protein, 16 aa, Homo sapiens
SKDHEELSLVASEAVR

SEQ ID NO: 68100 - protein, 24 aa, Homo sapiens
SVLLADVEDLIQQQISNDTVSPRA

SEQ ID NO: 68101 - protein, 7 aa, Homo sapiens
YPLYVLK

SEQ ID NO: 68102 - protein, 8 aa, Homo sapiens
YSFTIELR

SEQ ID NO: 68103 - protein, 27 aa, Homo sapiens
YTHGHGSETLYLAPGGGDDWIYDLGIK

SEQ ID NO: 68104 - protein, 24 aa, Homo sapiens
ANAVISVSGINHDVTSGDHGDYFR

SEQ ID NO: 68105 - protein, 22 aa, Homo sapiens
AVISVSGINHDVTSGDHGDYFR

SEQ ID NO: 68106 - protein, 15 aa, Homo sapiens
EALIQFLEQVHQGIK

SEQ ID NO: 68107 - protein, 15 aa, Homo sapiens
ELMLQLSEFLCEEFR

SEQ ID NO: 68108 - protein, 9 aa, Homo sapiens
FPPEEELQR

SEQ ID NO: 68109 - protein, 11 aa, Homo sapiens
GMQDFNYLHTN

SEQ ID NO: 68110 - protein, 35 aa, Homo sapiens
GMVLDENYNNLANAVISVSGINHDVTSGDHGDYFR

SEQ ID NO: 68111 - protein, 22 aa, Homo sapiens
HLYVLEFSDHPGIHEPLEPEVK

SEQ ID NO: 68112 - protein, 29 aa, Homo sapiens
IHILPSMNPDGYEVAAAQGPNKPGYLVGR

SEQ ID NO: 68113 - protein, 9 aa, Homo sapiens
IVQLIQDTR

SEQ ID NO: 68114 - protein, 14 aa, Homo sapiens
LHGGAVVANYPYDK

SEQ ID NO: 68115 - protein, 38 aa, Homo sapiens
LLLPGIYTVSATAPGYDPETVTVTVGPAEPTLVNFHLK

SEQ ID NO: 68116 - protein, 24 aa, Homo sapiens
MSDLLSVFLHLLLLFKLVAPVTFR

SEQ ID NO: 68117 - protein, 14 aa, Homo sapiens
NFPDLNTYIYYNEK

SEQ ID NO: 68118 - protein, 10 aa, Homo sapiens
NNANGVDLNR

SEQ ID NO: 68119 - protein, 10 aa, Homo sapiens
RSIPQVSPVR

SEQ ID NO: 68120 - protein, 17 aa, Homo sapiens
SANLHGGAVVANYPYDK

SEQ ID NO: 68121 - protein, 15 aa, Homo sapiens
SDHPGIHEPLEPEVK

SEQ ID NO: 68122 - protein, 19 aa, Homo sapiens
VLEFSDHPGIHEPLEPEVK

SEQ ID NO: 68123 - protein, 19 aa, Homo sapiens
VLSANLHGGAVVANYPYDK

SEQ ID NO: 68124 - protein, 10 aa, Homo sapiens
VQNECPGITR

SEQ ID NO: 68125 - protein, 6 aa, Homo sapiens
YDDLVR

SEQ ID NO: 68126 - protein, 15 aa, Homo sapiens
YGGPNHHLPLPDNWK

SEQ ID NO: 68127 - protein, 13 aa, Homo sapiens
YVGNMHGNEALGR

SEQ ID NO: 68128 - protein, 18 aa, Homo sapiens
AALESLHLQGNQLQALPR

SEQ ID NO: 68129 - protein, 12 aa, Homo sapiens
AEGTFAHLSNLR

SEQ ID NO: 68130 - protein, 10 aa, Homo sapiens
AFGSNPNLTK

SEQ ID NO: 68131 - protein, 12 aa, Homo sapiens
AGGSWDLAVQER

SEQ ID NO: 68132 - protein, 11 aa, Homo sapiens
AITHLPAGIFR

SEQ ID NO: 68133 - protein, 18 aa, Homo sapiens
AQLPEELFHPLTSLQTLK

SEQ ID NO: 68134 - protein, 13 aa, Homo sapiens
AYLFNWLQQYTDR

SEQ ID NO: 68135 - protein, 14 aa, Homo sapiens
DHLGFQVTWPDESK

SEQ ID NO: 68136 - protein, 33 aa, Homo sapiens
FNMLEALPEGLFQHLAALESLHLQGNQLQALPR

SEQ ID NO: 68137 - protein, 11 aa, Homo sapiens
FRPDAFGGLPR

SEQ ID NO: 68138 - protein, 10 aa, Homo sapiens
GQVVPALNEK

SEQ ID NO: 68139 - protein, 32 aa, Homo sapiens
KLGSLQELFLDSNNISELPPQVFSQLFCLERL

SEQ ID NO: 68140 - protein, 23 aa, Homo sapiens
KLYLGSNNLTALHPALFQNLSKL

SEQ ID NO: 68141 - protein, 19 aa, Homo sapiens
LAALESLHLQGNQLQALPR

SEQ ID NO: 68142 - protein, 19 aa, Homo sapiens
LAQLPEELFHPLTSLQTLK

SEQ ID NO: 68143 - protein, 24 aa, Homo sapiens
LAQNLLAQLPEELFHPLTSLQTLK

SEQ ID NO: 68144 - protein, 14 aa, Homo sapiens
LAYLFNWLQQYTDR

SEQ ID NO: 68145 - protein, 27 aa, Homo sapiens
LEDLEVTGSSFLNLSTNIFSNLTSLGK

SEQ ID NO: 68146 - protein, 8 aa, Homo sapiens
LELLSLSK

SEQ ID NO: 68147 - protein, 11 aa, Homo sapiens
LFNWLQQYTDR

SEQ ID NO: 68148 - protein, 9 aa, Homo sapiens
LFQPLTHLK

SEQ ID NO: 68149 - protein, 12 aa, Homo sapiens
LGSLQELFLDSN

SEQ ID NO: 68150 - protein, 30 aa, Homo sapiens
LGSLQELFLDSNNISELPPQVFSQLFCLER

SEQ ID NO: 68151 - protein, 19 aa, Homo sapiens
LGSNNLTALHPALFQNLSK

SEQ ID NO: 68152 - protein, 25 aa, Homo sapiens
LHGNPWQCDCHLAYLFNWLQQYTDR

SEQ ID NO: 68153 - protein, 20 aa, Homo sapiens
LLAQLPEELFHPLTSLQTLK

SEQ ID NO: 68154 - protein, 16 aa, Homo sapiens
LSNNALSGLPQGVFGK

SEQ ID NO: 68155 - protein, 37 aa, Homo sapiens
LTLNFNMLEALPEGLFQHLAALESLHLQGNQLQALPR

SEQ ID NO: 68156 - protein, 8 aa, Homo sapiens
LTVSIEAR

SEQ ID NO: 68157 - protein, 26 aa, Homo sapiens
LVGLSLTHNQLETVAEGTFAHLSNLR

SEQ ID NO: 68158 - protein, 21 aa, Homo sapiens
LYLGSNNLTALHPALFQNLSK

SEQ ID NO: 68159 - protein, 29 aa, Homo sapiens
LYLGSNNLTALHPALFQNLSKLELLSLSK

SEQ ID NO: 68160 - protein, 31 aa, Homo sapiens
MLEALPEGLFQHLAALESLHLQGNQLQALPR

SEQ ID NO: 68161 - protein, 12 aa, Homo sapiens
NAITHLPAGIFR

SEQ ID NO: 68162 - protein, 8 aa, Homo sapiens
NAITHLPL

SEQ ID NO: 68163 - protein, 11 aa, Homo sapiens
NAITHLPLSIF

SEQ ID NO: 68164 - protein, 13 aa, Homo sapiens
NALSGLPQGVFGK

SEQ ID NO: 68165 - protein, 15 aa, Homo sapiens
NIIFVETSFTTLETR

SEQ ID NO: 68166 - protein, 21 aa, Homo sapiens
NLLAQLPEELFHPLTSLQTLK

SEQ ID NO: 68167 - protein, 20 aa, Homo sapiens
NQLTTLPEGIFDTNYNLFNL

SEQ ID NO: 68168 - protein, 22 aa, Homo sapiens
NQLTTLPEGIFDTNYNLFNLAL

SEQ ID NO: 68169 - protein, 36 aa, Homo sapiens
NQLTTLPEGIFDTNYNLFNLALHGNPWQCDCHLAYL

SEQ ID NO: 68170 - protein, 9 aa, Homo sapiens
PDAFGGLPR

SEQ ID NO: 68171 - protein, 15 aa, Homo sapiens
PEELFHPLTSLQTLK

SEQ ID NO: 68172 - protein, 26 aa, Homo sapiens
PEGLFQHLAALESLHLQGNQLQALPR

SEQ ID NO: 68173 - protein, 17 aa, Homo sapiens
QGSLGLQYNASQEWDLR

SEQ ID NO: 68174 - protein, 17 aa, Homo sapiens
QLETVAEGTFAHLSNLR

SEQ ID NO: 68175 - protein, 12 aa, Homo sapiens
RAFGSNPNLTKV

SEQ ID NO: 68176 - protein, 29 aa, Homo sapiens
RLEDLEVTGSSFLNLSTNIFSNLTSLGKL

SEQ ID NO: 68177 - protein, 30 aa, Homo sapiens
RNAITHLPLSIFASLGNLTFLSLQWNMLRV

SEQ ID NO: 68178 - protein, 10 aa, Homo sapiens
RPDAFGGLPR

SEQ ID NO: 68179 - protein, 28 aa, Homo sapiens
RWLNVQLSPWQGSLGLQYNASQEWDLRS

SEQ ID NO: 68180 - protein, 10 aa, Homo sapiens
SGLPQGVFGK

SEQ ID NO: 68181 - protein, 18 aa, Homo sapiens
SLMLSYNAITHLPAGIFR

SEQ ID NO: 68182 - protein, 22 aa, Homo sapiens
SLTHNQLETVAEGTFAHLSNLR

SEQ ID NO: 68183 - protein, 20 aa, Homo sapiens
THNQLETVAEGTFAHLSNLR

SEQ ID NO: 68184 - protein, 20 aa, Homo sapiens
TLNLAQNLLAQLPEELFHPL

SEQ ID NO: 68185 - protein, 23 aa, Homo sapiens
TLNLAQNLLAQLPEELFHPLTSL

SEQ ID NO: 68186 - protein, 24 aa, Homo sapiens
TLNLAQNLLAQLPEELFHPLTSLQ

SEQ ID NO: 68187 - protein, 25 aa, Homo sapiens
TLNLAQNLLAQLPEELFHPLTSLQT

SEQ ID NO: 68188 - protein, 27 aa, Homo sapiens
TLNLAQNLLAQLPEELFHPLTSLQTLK

SEQ ID NO: 68189 - protein, 29 aa, Homo sapiens
TPCLVGLSLTHNQLETVAEGTFAHLSNLR

SEQ ID NO: 68190 - protein, 21 aa, Homo sapiens
VVFLNTQLCQFRPDAFGGLPR

SEQ ID NO: 68191 - protein, 13 aa, Homo sapiens
WLNVQLSPWQGSL

SEQ ID NO: 68192 - protein, 19 aa, Homo sapiens
WQGSLGLQYNASQEWDLRS

SEQ ID NO: 68193 - protein, 15 aa, Homo sapiens
LLNIQTYCAGPAYLK

SEQ ID NO: 68194 - protein, 8 aa, Homo sapiens
QLVCPVTR

SEQ ID NO: 68195 - protein, 10 aa, Homo sapiens
RLFQPLTHLK

SEQ ID NO: 68196 - protein, 22 aa, Homo sapiens
SQCTYSNPEGTVVLACDQAQCR

SEQ ID NO: 68197 - protein, 12 aa, Homo sapiens
VVFLNTQLCQFR

SEQ ID NO: 68198 - protein, 9 aa, Homo sapiens
WLNVQLSPR

SEQ ID NO: 68199 - protein, 6 aa, Homo sapiens
AFVFPK

SEQ ID NO: 68200 - protein, 8 aa, Homo sapiens
APLTKPLK

SEQ ID NO: 68201 - protein, 10 aa, Homo sapiens
ESDTSYVSLK

SEQ ID NO: 68202 - protein, 10 aa, Homo sapiens
GYSIFSYATK

SEQ ID NO: 68203 - protein, 12 aa, Homo sapiens
RQDNEILIFWSK

SEQ ID NO: 68204 - protein, 10 aa, Homo sapiens
YEVQGEVFTK

SEQ ID NO: 68205 - protein, 15 aa, Homo sapiens
YEVQGEVFTKPQLWP

SEQ ID NO: 68206 - protein, 26 aa, Homo sapiens
KDIDVSPKHVGFATIPRNYTMSFLPR

SEQ ID NO: 68207 - protein, 14 aa, Homo sapiens
FSVSTLRNLGLGKK

SEQ ID NO: 68208 - protein, 13 aa, Homo sapiens
VQQEIDDVIGQVR

SEQ ID NO: 68209 - protein, 20 aa, Homo sapiens
KNITDELGVLGVAGPQARKV

SEQ ID NO: 68210 - protein, 33 aa, Homo sapiens
ESGYMHIQCTKPDTVGSALNDSPVGLAAYILEK

SEQ ID NO: 68211 - protein, 20 aa, Homo sapiens
FTPPLEDSCFHYGFNSNYLK

SEQ ID NO: 68212 - protein, 23 aa, Homo sapiens
IEGLDIHFIHVKPPQLPAGHTPK

SEQ ID NO: 68213 - protein, 19 aa, Homo sapiens
MALVLSNFSTLTLLLGQRF

SEQ ID NO: 68214 - protein, 28 aa, Homo sapiens
NHGLSDEHVFEVICPSIPGYGFSEASSK

SEQ ID NO: 68215 - protein, 17 aa, Homo sapiens
PLLMVHGWPGSFYEFYK

SEQ ID NO: 68216 - protein, 18 aa, Homo sapiens
PPLEDSCFHYGFNSNYLK

SEQ ID NO: 68217 - protein, 20 aa, Homo sapiens
VYVPTGFSAFPFELLHTPEK

SEQ ID NO: 68218 - protein, 17 aa, Homo sapiens
CLLFTFTAESPSEDPTR

SEQ ID NO: 68219 - protein, 17 aa, Homo sapiens
CQFFTYTPAQASCNEGK

SEQ ID NO: 68220 - protein, 15 aa, Homo sapiens
CTDDVHCHFFTYATR

SEQ ID NO: 68221 - protein, 6 aa, Homo sapiens
DIALLK

SEQ ID NO: 68222 - protein, 26 aa, Homo sapiens
DIFPNTVFADSNIDSVMAPDAFVCGR

SEQ ID NO: 68223 - protein, 9 aa, Homo sapiens
DSVTETLPR

SEQ ID NO: 68224 - protein, 18 aa, Homo sapiens
DTCFEGGDITTVFTPSAK

SEQ ID NO: 68225 - protein, 18 aa, Homo sapiens
EDTSFFGVQEIIIHDQYK

SEQ ID NO: 68226 - protein, 19 aa, Homo sapiens
ERPGVYTNVVEYVDWILEK

SEQ ID NO: 68227 - protein, 10 aa, Homo sapiens
GEWPWQVTLH

SEQ ID NO: 68228 - protein, 17 aa, Homo sapiens
GEWPWQVTLHTTSPTQR

SEQ ID NO: 68229 - protein, 10 aa, Homo sapiens
GINYNSSVAK

SEQ ID NO: 68230 - protein, 27 aa, Homo sapiens
HLCGGSIIGNQWILTAAHCFYGVESPK

SEQ ID NO: 68231 - protein, 20 aa, Homo sapiens
HNEVWHLVGITSWGEGCAQR

SEQ ID NO: 68232 - protein, 28 aa, Homo sapiens
HSIPVFCHSSFYHDTDFLGEELDIVAAK

SEQ ID NO: 68233 - protein, 21 aa, Homo sapiens
HSSFYHDTDFLGEELDIVAAK

SEQ ID NO: 68234 - protein, 11 aa, Homo sapiens
IPLVTNEECQK

SEQ ID NO: 68235 - protein, 26 aa, Homo sapiens
IVGGTASVRGEWPWQVTLHTTSPTQR

SEQ ID NO: 68236 - protein, 12 aa, Homo sapiens
KGINYNSSVAKS

SEQ ID NO: 68237 - protein, 14 aa, Homo sapiens
KLETTVNYTDSQRP

SEQ ID NO: 68238 - protein, 21 aa, Homo sapiens
KLETTVNYTDSQRPICLPSKG

SEQ ID NO: 68239 - protein, 19 aa, Homo sapiens
LETTVNYTDSQRPICLPSK

SEQ ID NO: 68240 - protein, 22 aa, Homo sapiens
LETTVNYTDSQRPICLPSKGDR

SEQ ID NO: 68241 - protein, 12 aa, Homo sapiens
MAESGYDIALLK

SEQ ID NO: 68242 - protein, 15 aa, Homo sapiens
NVIYTDCWVTGWGYR

SEQ ID NO: 68243 - protein, 14 aa, Homo sapiens
RVYSGILNQSEIKE

SEQ ID NO: 68244 - protein, 11 aa, Homo sapiens
SCALSNLACIR

SEQ ID NO: 68245 - protein, 20 aa, Homo sapiens
SSFYHDTDFLGEELDIVAAK

SEQ ID NO: 68246 - protein, 10 aa, Homo sapiens
TAAISGYSFK

SEQ ID NO: 68247 - protein, 13 aa, Homo sapiens
TFTAESPSEDPTR

SEQ ID NO: 68248 - protein, 10 aa, Homo sapiens
TSESGLPSTR

SEQ ID NO: 68249 - protein, 12 aa, Homo sapiens
VYSGILNQSEIK

SEQ ID NO: 68250 - protein, 30 aa, Homo sapiens
VYSGILNQSEIKEDTSFFGVQEIIIHDQYK

SEQ ID NO: 68251 - protein, 11 aa, Homo sapiens
YCQVVCTYHPR

SEQ ID NO: 68252 - protein, 17 aa, Homo sapiens
YHDTDFLGEELDIVAAK

SEQ ID NO: 68253 - protein, 23 aa, Homo sapiens
AEEHTVVLTVTGEPCHFPFQYHR

SEQ ID NO: 68254 - protein, 8 aa, Homo sapiens
CFEPQLLR

SEQ ID NO: 68255 - protein, 8 aa, Homo sapiens
CLEVEGHR

SEQ ID NO: 68256 - protein, 19 aa, Homo sapiens
CLQDRPAPEDLTVVLGQER

SEQ ID NO: 68257 - protein, 10 aa, Homo sapiens
FFHKNEIWYR

SEQ ID NO: 68258 - protein, 18 aa, Homo sapiens
FFHKNEIWYRTEQAAVAR

SEQ ID NO: 68259 - protein, 26 aa, Homo sapiens
GHQFEGAEEYASFLQEAQVPFLSLER

SEQ ID NO: 68260 - protein, 8 aa, Homo sapiens
GPDAHCQR

SEQ ID NO: 68261 - protein, 12 aa, Homo sapiens
GPLVCEDQAAER

SEQ ID NO: 68262 - protein, 20 aa, Homo sapiens
GRPGPQPWCATTPNFDQDQR

SEQ ID NO: 68263 - protein, 8 aa, Homo sapiens
IPPWEAPK

SEQ ID NO: 68264 - protein, 18 aa, Homo sapiens
LCHCPVGYTGPFCDVDTK

SEQ ID NO: 68265 - protein, 10 aa, Homo sapiens
LHEAFSPVSY

SEQ ID NO: 68266 - protein, 12 aa, Homo sapiens
LHEAFSPVSYQH

SEQ ID NO: 68267 - protein, 18 aa, Homo sapiens
LHEAFSPVSYQHDLALLR

SEQ ID NO: 68268 - protein, 27 aa, Homo sapiens
LQEDADGSCALLSPYVQPVCLPSGAAR

SEQ ID NO: 68269 - protein, 16 aa, Homo sapiens
LTLQGIISWGSGCGDR

SEQ ID NO: 68270 - protein, 9 aa, Homo sapiens
NGPLSCGQR

SEQ ID NO: 68271 - protein, 13 aa, Homo sapiens
NHSCEPCQTLAVR

SEQ ID NO: 68272 - protein, 11 aa, Homo sapiens
NKPGVYTDVAY

SEQ ID NO: 68273 - protein, 17 aa, Homo sapiens
NKPGVYTDVAYYLAWIR

SEQ ID NO: 68274 - protein, 9 aa, Homo sapiens
NPDNDIRPW

SEQ ID NO: 68275 - protein, 11 aa, Homo sapiens
NPDNDIRPWCF

SEQ ID NO: 68276 - protein, 15 aa, Homo sapiens
NPDNDIRPWCFVLNR

SEQ ID NO: 68277 - protein, 8 aa, Homo sapiens
NVTAEQAR

SEQ ID NO: 68278 - protein, 9 aa, Homo sapiens
NWGLGGHAF

SEQ ID NO: 68279 - protein, 11 aa, Homo sapiens
NWGLGGHAFCR

SEQ ID NO: 68280 - protein, 14 aa, Homo sapiens
PAPEDLTVVLGQER

SEQ ID NO: 68281 - protein, 12 aa, Homo sapiens
PVSYQHDLALLR

SEQ ID NO: 68282 - protein, 8 aa, Homo sapiens
PWCFVLNR

SEQ ID NO: 68283 - protein, 17 aa, Homo sapiens
RLTLQGIISWGSGCGDR

SEQ ID NO: 68284 - protein, 14 aa, Homo sapiens
RNHSCEPCQTLAVR

SEQ ID NO: 68285 - protein, 15 aa, Homo sapiens
RNHSCEPCQTLAVRS

SEQ ID NO: 68286 - protein, 10 aa, Homo sapiens
RNVTAEQARN

SEQ ID NO: 68287 - protein, 16 aa, Homo sapiens
RRNHSCEPCQTLAVRS

SEQ ID NO: 68288 - protein, 13 aa, Homo sapiens
SPVSYQHDLALLR

SEQ ID NO: 68289 - protein, 10 aa, Homo sapiens
SYQHDLALLR

SEQ ID NO: 68290 - protein, 21 aa, Homo sapiens
SYRLHEAFSPVSYQHDLALLR

SEQ ID NO: 68291 - protein, 21 aa, Homo sapiens
TDACQGDSGGPLVCEDQAAER

SEQ ID NO: 68292 - protein, 11 aa, Homo sapiens
TDVAYYLAWIR

SEQ ID NO: 68293 - protein, 18 aa, Homo sapiens
TTLSGAPCQPWASEATYR

SEQ ID NO: 68294 - protein, 26 aa, Homo sapiens
TTLSGAPCQPWASEATYRNVTAEQAR

SEQ ID NO: 68295 - protein, 9 aa, Homo sapiens
VVGGLVALR

SEQ ID NO: 68296 - protein, 8 aa, Homo sapiens
WGYCLEPK

SEQ ID NO: 68297 - protein, 25 aa, Homo sapiens
YKAEEHTVVLTVTGEPCHFPFQYHR

SEQ ID NO: 68298 - protein, 11 aa, Homo sapiens
CFDHHFLEGSR

SEQ ID NO: 68299 - protein, 25 aa, Homo sapiens
CLDGMWTTPPLCLEPCTLSFTEMEK

SEQ ID NO: 68300 - protein, 8 aa, Homo sapiens
CNEYYLLR

SEQ ID NO: 68301 - protein, 11 aa, Homo sapiens
CPPPPLPINSK

SEQ ID NO: 68302 - protein, 15 aa, Homo sapiens
CTKPDLSNGYISDVK

SEQ ID NO: 68303 - protein, 19 aa, Homo sapiens
DEEVVQCLSDGWSSQPTCR

SEQ ID NO: 68304 - protein, 17 aa, Homo sapiens
DKVQYECATGYYTAGGK

SEQ ID NO: 68305 - protein, 20 aa, Homo sapiens
EHETCLAPELYNGNYSTTQK

SEQ ID NO: 68306 - protein, 20 aa, Homo sapiens
GAVADGILASYATGSSVEYR

SEQ ID NO: 68307 - protein, 13 aa, Homo sapiens
GDTYPAELYITGS

SEQ ID NO: 68308 - protein, 16 aa, Homo sapiens
GDTYPAELYITGSILR

SEQ ID NO: 68309 - protein, 10 aa, Homo sapiens
GMCTSPPLIK

SEQ ID NO: 68310 - protein, 21 aa, Homo sapiens
HGVIISSTVDTYENGSSVEYR

SEQ ID NO: 68311 - protein, 27 aa, Homo sapiens
HPPVVMNGAVADGILASYATGSSVEYR

SEQ ID NO: 68312 - protein, 9 aa, Homo sapiens
IAQYYYTFK

SEQ ID NO: 68313 - protein, 10 aa, Homo sapiens
IENGYFHPVK

SEQ ID NO: 68314 - protein, 14 aa, Homo sapiens
IQENMHYGCASGYK

SEQ ID NO: 68315 - protein, 9 aa, Homo sapiens
IQTHSTTYR

SEQ ID NO: 68316 - protein, 13 aa, Homo sapiens
IYYNGDKVTYACK

SEQ ID NO: 68317 - protein, 16 aa, Homo sapiens
KCTKPDLSNGYISDVK

SEQ ID NO: 68318 - protein, 21 aa, Homo sapiens
KEHETCLAPELYNGNYSTTQK

SEQ ID NO: 68319 - protein, 22 aa, Homo sapiens
KEHETCLAPELYNGNYSTTQKT

SEQ ID NO: 68320 - protein, 23 aa, Homo sapiens
KHGVIISSTVDTYENGSSVEYRC

SEQ ID NO: 68321 - protein, 17 aa, Homo sapiens
KTEEVECLTYGWSLTPK

SEQ ID NO: 68322 - protein, 11 aa, Homo sapiens
LIENGYFHPVK

SEQ ID NO: 68323 - protein, 15 aa, Homo sapiens
LSFFCLAGYTTESGR

SEQ ID NO: 68324 - protein, 12 aa, Homo sapiens
MQCDRGQLKYPR

SEQ ID NO: 68325 - protein, 6 aa, Homo sapiens
NNIEMK

SEQ ID NO: 68326 - protein, 12 aa, Homo sapiens
PAELYITGSILR

SEQ ID NO: 68327 - protein, 12 aa, Homo sapiens
PDLSNGYISDVK

SEQ ID NO: 68328 - protein, 17 aa, Homo sapiens
QEEQTTCTTEGWSPEPR

SEQ ID NO: 68329 - protein, 20 aa, Homo sapiens
QGYDLSPLTPLSELSVQCNR

SEQ ID NO: 68330 - protein, 21 aa, Homo sapiens
QGYDLSPLTPLSELSVQCNRG

SEQ ID NO: 68331 - protein, 11 aa, Homo sapiens
QSTLSYQEPLR

SEQ ID NO: 68332 - protein, 12 aa, Homo sapiens
QSTLSYQEPLRT

SEQ ID NO: 68333 - protein, 10 aa, Homo sapiens
SFYFPMSIDK

SEQ ID NO: 68334 - protein, 15 aa, Homo sapiens
SGYLLHGSNEITCNR

SEQ ID NO: 68335 - protein, 16 aa, Homo sapiens
SGYLLHGSNEITCNRG

SEQ ID NO: 68336 - protein, 16 aa, Homo sapiens
TEEVECLTYGWSLTPK

SEQ ID NO: 68337 - protein, 9 aa, Homo sapiens
TLSFTEMEK

SEQ ID NO: 68338 - protein, 24 aa, Homo sapiens
TTGGKDEEVVQCLSDGWSSQPTCR

SEQ ID NO: 68339 - protein, 9 aa, Homo sapiens
TVNVDYMNR

SEQ ID NO: 68340 - protein, 11 aa, Homo sapiens
TYENGSSVEYR

SEQ ID NO: 68341 - protein, 19 aa, Homo sapiens
VACEEPPFIENGAANLHSK

SEQ ID NO: 68342 - protein, 12 aa, Homo sapiens
VLHGDLIDFVCK

SEQ ID NO: 68343 - protein, 15 aa, Homo sapiens
VQYECATGYYTAGGK

SEQ ID NO: 68344 - protein, 8 aa, Homo sapiens
WDFDNRPH

SEQ ID NO: 68345 - protein, 20 aa, Homo sapiens
WSSPPVCLEPCTVNVDYMNR

SEQ ID NO: 68346 - protein, 13 aa, Homo sapiens
WTEPPKCIEGQEK

SEQ ID NO: 68347 - protein, 15 aa, Homo sapiens
WTLPPECVENNENCK

SEQ ID NO: 68348 - protein, 17 aa, Homo sapiens
DDINSYECWCPFGFEGK

SEQ ID NO: 68349 - protein, 13 aa, Homo sapiens
DHENANKILNRPK

SEQ ID NO: 68350 - protein, 11 aa, Homo sapiens
FGSGYVSGWGR

SEQ ID NO: 68351 - protein, 13 aa, Homo sapiens
IIPHHNYNAAINK

SEQ ID NO: 68352 - protein, 19 aa, Homo sapiens
ITVVAGEHNIEETEHTEQK

SEQ ID NO: 68353 - protein, 20 aa, Homo sapiens
ITVVAGEHNIEETEHTEQKR

SEQ ID NO: 68354 - protein, 11 aa, Homo sapiens
NCELDVTCNIK

SEQ ID NO: 68355 - protein, 13 aa, Homo sapiens
PGQFPWQVVLNGK

SEQ ID NO: 68356 - protein, 9 aa, Homo sapiens
SALVLQYLR

SEQ ID NO: 68357 - protein, 15 aa, Homo sapiens
SALVLQYLRVPLVDR

SEQ ID NO: 68358 - protein, 12 aa, Homo sapiens
SCEPAVPFPCGR

SEQ ID NO: 68359 - protein, 13 aa, Homo sapiens
VDAFCGGSIVNEK

SEQ ID NO: 68360 - protein, 11 aa, Homo sapiens
VSVSQTSKLTR

SEQ ID NO: 68361 - protein, 10 aa, Homo sapiens
VVCSCTEGYR

SEQ ID NO: 68362 - protein, 21 aa, Homo sapiens
VVGGEDAKPGQFPWQVVLNGK

SEQ ID NO: 68363 - protein, 14 aa, Homo sapiens
WIVTAAHCVETGVK

SEQ ID NO: 68364 - protein, 19 aa, Homo sapiens
YNHDIALLELDEPLVLNSY

SEQ ID NO: 68365 - protein, 28 aa, Homo sapiens
YNHDIALLELDEPLVLNSYVTPICIADK

SEQ ID NO: 68366 - protein, 11 aa, Homo sapiens
ALTAQGTSELR

SEQ ID NO: 68367 - protein, 6 aa, Homo sapiens
DWATYK

SEQ ID NO: 68368 - protein, 16 aa, Homo sapiens
GHFLSGWHTIYLPDCR

SEQ ID NO: 68369 - protein, 13 aa, Homo sapiens
GTHGSFANGINWK

SEQ ID NO: 68370 - protein, 12 aa, Homo sapiens
LGEFWLGNDNIH

SEQ ID NO: 68371 - protein, 23 aa, Homo sapiens
LGEFWLGNDNIHALTAQGTSELR

SEQ ID NO: 68372 - protein, 9 aa, Homo sapiens
MVGLEGSDK

SEQ ID NO: 68373 - protein, 14 aa, Homo sapiens
MVGLEGSDKLTILR

SEQ ID NO: 68374 - protein, 10 aa, Homo sapiens
NCHVSNLNGR

SEQ ID NO: 68375 - protein, 9 aa, Homo sapiens
VDGSVDFYR

SEQ ID NO: 68376 - protein, 14 aa, Homo sapiens
VDLVDFEDNYQFAK

SEQ ID NO: 68377 - protein, 10 aa, Homo sapiens
AIFYMNNPSR

SEQ ID NO: 68378 - protein, 15 aa, Homo sapiens
ASSQWVVGPSYFVEY

SEQ ID NO: 68379 - protein, 18 aa, Homo sapiens
ASSQWVVGPSYFVEYLIK

SEQ ID NO: 68380 - protein, 13 aa, Homo sapiens
DINKDRKDGYVLR

SEQ ID NO: 68381 - protein, 16 aa, Homo sapiens
GCNDSDVLAVAGFALR

SEQ ID NO: 68382 - protein, 22 aa, Homo sapiens
GGLGSLFYLTLDVLETDCHVLR

SEQ ID NO: 68383 - protein, 12 aa, Homo sapiens
GSVQYLPDLDDK

SEQ ID NO: 68384 - protein, 17 aa, Homo sapiens
GSVQYLPDLDDKNSQEK

SEQ ID NO: 68385 - protein, 11 aa, Homo sapiens
IFFESVYGQCK

SEQ ID NO: 68386 - protein, 31 aa, Homo sapiens
IYMTCPDCPSSIPTDSSNHQVLEAATESLAK

SEQ ID NO: 68387 - protein, 10 aa, Homo sapiens
KYNNENTSKQ

SEQ ID NO: 68388 - protein, 8 aa, Homo sapiens
LVVLPFPK

SEQ ID NO: 68389 - protein, 16 aa, Homo sapiens
MSPPQLALNPSALLSR

SEQ ID NO: 68390 - protein, 15 aa, Homo sapiens
RGCNDSDVLAVAGFA

SEQ ID NO: 68391 - protein, 18 aa, Homo sapiens
RGCNDSDVLAVAGFALRD

SEQ ID NO: 68392 - protein, 18 aa, Homo sapiens
RVLYLAAYNCTLRPVSKK

SEQ ID NO: 68393 - protein, 15 aa, Homo sapiens
SPPQLALNPSALLSR

SEQ ID NO: 68394 - protein, 20 aa, Homo sapiens
SQASSCSLQSSDSVPVGLCK

SEQ ID NO: 68395 - protein, 18 aa, Homo sapiens
TAECPGPAQNASPLVLPP

SEQ ID NO: 68396 - protein, 16 aa, Homo sapiens
VLYLAAYNCTLRPVSK

SEQ ID NO: 68397 - protein, 14 aa, Homo sapiens
YLAAYNCTLRPVSK

SEQ ID NO: 68398 - protein, 11 aa, Homo sapiens
AAFFDTASTGK

SEQ ID NO: 68399 - protein, 17 aa, Homo sapiens
ADEAGSEADHEGTHSTK

SEQ ID NO: 68400 - protein, 16 aa, Homo sapiens
ADSGEGDFLAEGGGVR

SEQ ID NO: 68401 - protein, 19 aa, Homo sapiens
ADSGEGDFLAEGGGVRGPR

SEQ ID NO: 68402 - protein, 14 aa, Homo sapiens
AGSEADHEGTHSTK

SEQ ID NO: 68403 - protein, 17 aa, Homo sapiens
AGSWNSGSSGPGSTGNR

SEQ ID NO: 68404 - protein, 24 aa, Homo sapiens
ALAREVDLKDYEDQQKQLEQVIAK

SEQ ID NO: 68405 - protein, 9 aa, Homo sapiens
ALTDMPQMR

SEQ ID NO: 68406 - protein, 7 aa, Homo sapiens
AQLVDMK

SEQ ID NO: 68407 - protein, 8 aa, Homo sapiens
AQLVDMKR

SEQ ID NO: 68408 - protein, 23 aa, Homo sapiens
ARPNNPDWGTFEEVSGNVSPGTR

SEQ ID NO: 68409 - protein, 25 aa, Homo sapiens
ASTGKTFPGFFSPMLGEFVSETESR

SEQ ID NO: 68410 - protein, 13 aa, Homo sapiens
DEAAFFDTASTGK

SEQ ID NO: 68411 - protein, 16 aa, Homo sapiens
DEAGSEADHEGTHSTK

SEQ ID NO: 68412 - protein, 10 aa, Homo sapiens
DEVNQDFTNR

SEQ ID NO: 68413 - protein, 24 aa, Homo sapiens
DGSDCPEAMDLGTLSGIGTLDGFR

SEQ ID NO: 68414 - protein, 15 aa, Homo sapiens
DLGTLSGIGTLDGFR

SEQ ID NO: 68415 - protein, 6 aa, Homo sapiens
DLLPSR

SEQ ID NO: 68416 - protein, 15 aa, Homo sapiens
DLLPSRDRQHLPLIK

SEQ ID NO: 68417 - protein, 9 aa, Homo sapiens
DRQHLPLIK

SEQ ID NO: 68418 - protein, 15 aa, Homo sapiens
DSDWPFCSDEDWNYK

SEQ ID NO: 68419 - protein, 15 aa, Homo sapiens
DSGEGDFLAEGGGVR

SEQ ID NO: 68420 - protein, 14 aa, Homo sapiens
DSHSLTTNIMEILR

SEQ ID NO: 68421 - protein, 7 aa, Homo sapiens
DYEDQQK

SEQ ID NO: 68422 - protein, 15 aa, Homo sapiens
DYEDQQKQLEQVIAK

SEQ ID NO: 68423 - protein, 15 aa, Homo sapiens
EAGSEADHEGTHSTK

SEQ ID NO: 68424 - protein, 12 aa, Homo sapiens
EKVTSGSTTTTR

SEQ ID NO: 68425 - protein, 13 aa, Homo sapiens
EKVTSGSTTTTRR

SEQ ID NO: 68426 - protein, 28 aa, Homo sapiens
ELERPGGNEITRGGSTSYGTGSETESPR

SEQ ID NO: 68427 - protein, 31 aa, Homo sapiens
ESRGSESGIFTNTKESSSHHPGIAEFPSRGK

SEQ ID NO: 68428 - protein, 15 aa, Homo sapiens
ESSSHHPGIAEFPSR

SEQ ID NO: 68429 - protein, 17 aa, Homo sapiens
ESSSHHPGIAEFPSRGK

SEQ ID NO: 68430 - protein, 23 aa, Homo sapiens
ESSSHHPGIAEFPSRGKSSSYSK

SEQ ID NO: 68431 - protein, 11 aa, Homo sapiens
EVDLKDYEDQQ

SEQ ID NO: 68432 - protein, 12 aa, Homo sapiens
EVDLKDYEDQQK

SEQ ID NO: 68433 - protein, 20 aa, Homo sapiens
EVDLKDYEDQQKQLEQVIAK

SEQ ID NO: 68434 - protein, 26 aa, Homo sapiens
EVDLKDYEDQQKQLEQVIAKDLLPSR

SEQ ID NO: 68435 - protein, 28 aa, Homo sapiens
EVDLKDYEDQQKQLEQVIAKDLLPSRDR

SEQ ID NO: 68436 - protein, 30 aa, Homo sapiens
EVVTSEDGSDCPEAMDLGTLSGIGTLDGFR

SEQ ID NO: 68437 - protein, 32 aa, Homo sapiens
EVVTSEDGSDCPEAMDLGTLSGIGTLDGFRHR

SEQ ID NO: 68438 - protein, 11 aa, Homo sapiens
EYHTEKLVTSK

SEQ ID NO: 68439 - protein, 14 aa, Homo sapiens
EYHTEKLVTSKGDK

SEQ ID NO: 68440 - protein, 16 aa, Homo sapiens
EYHTEKLVTSKGDKEL

SEQ ID NO: 68441 - protein, 17 aa, Homo sapiens
EYHTEKLVTSKGDKELR

SEQ ID NO: 68442 - protein, 19 aa, Homo sapiens
EYHTEKLVTSKGDKELRTG

SEQ ID NO: 68443 - protein, 20 aa, Homo sapiens
EYHTEKLVTSKGDKELRTGK

SEQ ID NO: 68444 - protein, 22 aa, Homo sapiens
EYHTEKLVTSKGDKELRTGKEK

SEQ ID NO: 68445 - protein, 32 aa, Homo sapiens
EYHTEKLVTSKGDKELRTGKEKVTSGSTTTTR

SEQ ID NO: 68446 - protein, 28 aa, Homo sapiens
FDTASTGKTFPGFFSPMLGEFVSETESR

SEQ ID NO: 68447 - protein, 16 aa, Homo sapiens
FFSPMLGEFVSETESR

SEQ ID NO: 68448 - protein, 19 aa, Homo sapiens
FPGFFSPMLGEFVSETESR

SEQ ID NO: 68449 - protein, 15 aa, Homo sapiens
FSPMLGEFVSETESR

SEQ ID NO: 68450 - protein, 9 aa, Homo sapiens
GDFSSANNR

SEQ ID NO: 68451 - protein, 14 aa, Homo sapiens
GDFSSANNRDNTYN

SEQ ID NO: 68452 - protein, 15 aa, Homo sapiens
GDFSSANNRDNTYNR

SEQ ID NO: 68453 - protein, 21 aa, Homo sapiens
GDKELRTGKEKVTSGSTTTTR

SEQ ID NO: 68454 - protein, 8 aa, Homo sapiens
GDSTFESK

SEQ ID NO: 68455 - protein, 13 aa, Homo sapiens
GEGDFLAEGGGVR

SEQ ID NO: 68456 - protein, 26 aa, Homo sapiens
GFGSLNDEGEGEFWLGNDYLHLLTQR

SEQ ID NO: 68457 - protein, 16 aa, Homo sapiens
GGSTSYGTGSETESPR

SEQ ID NO: 68458 - protein, 17 aa, Homo sapiens
GGSTSYGTGSETESPRN

SEQ ID NO: 68459 - protein, 19 aa, Homo sapiens
GGSTSYGTGSETESPRNPS

SEQ ID NO: 68460 - protein, 22 aa, Homo sapiens
GGSTSYGTGSETESPRNPSSAG

SEQ ID NO: 68461 - protein, 23 aa, Homo sapiens
GGSTSYGTGSETESPRNPSSAGS

SEQ ID NO: 68462 - protein, 25 aa, Homo sapiens
GGSTSYGTGSETESPRNPSSAGSWN

SEQ ID NO: 68463 - protein, 36 aa, Homo sapiens
GGSTSYGTGSETESPRNPSSAGSWNSGSSGPGSTGN

SEQ ID NO: 68464 - protein, 37 aa, Homo sapiens
GGSTSYGTGSETESPRNPSSAGSWNSGSSGPGSTGNR

SEQ ID NO: 68465 - protein, 38 aa, Homo sapiens
GGSTSYGTGSETESPRNPSSAGSWNSGSSGPGSTGNRN

SEQ ID NO: 68466 - protein, 9 aa, Homo sapiens
GIGTLDGFR

SEQ ID NO: 68467 - protein, 14 aa, Homo sapiens
GKSSSYSKQFTSST

SEQ ID NO: 68468 - protein, 26 aa, Homo sapiens
GKSSSYSKQFTSSTSYNRGDSTFESK

SEQ ID NO: 68469 - protein, 28 aa, Homo sapiens
GKSSSYSKQFTSSTSYNRGDSTFESKSY

SEQ ID NO: 68470 - protein, 29 aa, Homo sapiens
GKSSSYSKQFTSSTSYNRGDSTFESKSYK

SEQ ID NO: 68471 - protein, 12 aa, Homo sapiens
GLIDEVNQDFTN

SEQ ID NO: 68472 - protein, 13 aa, Homo sapiens
GLIDEVNQDFTNR

SEQ ID NO: 68473 - protein, 16 aa, Homo sapiens
GLIDEVNQDFTNRINK

SEQ ID NO: 68474 - protein, 18 aa, Homo sapiens
GLIDEVNQDFTNRINKLK

SEQ ID NO: 68475 - protein, 15 aa, Homo sapiens
GSAGHWTSESSVSGS

SEQ ID NO: 68476 - protein, 18 aa, Homo sapiens
GSAGHWTSESSVSGSTGQ

SEQ ID NO: 68477 - protein, 20 aa, Homo sapiens
GSAGHWTSESSVSGSTGQWH

SEQ ID NO: 68478 - protein, 24 aa, Homo sapiens
GSAGHWTSESSVSGSTGQWHSESG

SEQ ID NO: 68479 - protein, 27 aa, Homo sapiens
GSAGHWTSESSVSGSTGQWHSESGSFR

SEQ ID NO: 68480 - protein, 35 aa, Homo sapiens
GSAGHWTSESSVSGSTGQWHSESGSFRPDSPGSGN

SEQ ID NO: 68481 - protein, 37 aa, Homo sapiens
GSAGHWTSESSVSGSTGQWHSESGSFRPDSPGSGNAR

SEQ ID NO: 68482 - protein, 39 aa, Homo sapiens
GSAGHWTSESSVSGSTGQWHSESGSFRPDSPGSGNARPN

SEQ ID NO: 68483 - protein, 13 aa, Homo sapiens
GSEADHEGTHSTK

SEQ ID NO: 68484 - protein, 11 aa, Homo sapiens
GSESGIFTNTK

SEQ ID NO: 68485 - protein, 26 aa, Homo sapiens
GSESGIFTNTKESSSHHPGIAEFPSR

SEQ ID NO: 68486 - protein, 27 aa, Homo sapiens
GSESGIFTNTKESSSHHPGIAEFPSRG

SEQ ID NO: 68487 - protein, 28 aa, Homo sapiens
GSESGIFTNTKESSSHHPGIAEFPSRGK

SEQ ID NO: 68488 - protein, 34 aa, Homo sapiens
GSESGIFTNTKESSSHHPGIAEFPSRGKSSSYSK

SEQ ID NO: 68489 - protein, 16 aa, Homo sapiens
GSWNSGSSGPGSTGNR

SEQ ID NO: 68490 - protein, 13 aa, Homo sapiens
GTLSGIGTLDGFR

SEQ ID NO: 68491 - protein, 11 aa, Homo sapiens
HHPGIAEFPSR

SEQ ID NO: 68492 - protein, 15 aa, Homo sapiens
HPDEAAFFDTASTGK

SEQ ID NO: 68493 - protein, 12 aa, Homo sapiens
HRHPDEAAFFDT

SEQ ID NO: 68494 - protein, 13 aa, Homo sapiens
HRHPDEAAFFDTA

SEQ ID NO: 68495 - protein, 16 aa, Homo sapiens
HRHPDEAAFFDTASTG

SEQ ID NO: 68496 - protein, 17 aa, Homo sapiens
HRHPDEAAFFDTASTGK

SEQ ID NO: 68497 - protein, 11 aa, Homo sapiens
IDEVNQDFTNR

SEQ ID NO: 68498 - protein, 6 aa, Homo sapiens
IEVLKR

SEQ ID NO: 68499 - protein, 16 aa, Homo sapiens
INKLKNSLFEYQKNNK

SEQ ID NO: 68500 - protein, 15 aa, Homo sapiens
KDSHSLTTNIMEILR

SEQ ID NO: 68501 - protein, 16 aa, Homo sapiens
KESSSHHPGIAEFPSR

SEQ ID NO: 68502 - protein, 18 aa, Homo sapiens
KESSSHHPGIAEFPSRGK

SEQ ID NO: 68503 - protein, 12 aa, Homo sapiens
KPVPDLVPGNFK

SEQ ID NO: 68504 - protein, 21 aa, Homo sapiens
KTFPGFFSPMLGEFVSETESR

SEQ ID NO: 68505 - protein, 14 aa, Homo sapiens
KVIEKVQHIQLLQK

SEQ ID NO: 68506 - protein, 11 aa, Homo sapiens
LERPGGNEITR

SEQ ID NO: 68507 - protein, 8 aa, Homo sapiens
LEVDIDIK

SEQ ID NO: 68508 - protein, 11 aa, Homo sapiens
LGEFVSETESR

SEQ ID NO: 68509 - protein, 22 aa, Homo sapiens
LGEFVSETESRGSESGIFTNTK

SEQ ID NO: 68510 - protein, 14 aa, Homo sapiens
LGTLSGIGTLDGFR

SEQ ID NO: 68511 - protein, 10 aa, Homo sapiens
LKNSLFEYQK

SEQ ID NO: 68512 - protein, 12 aa, Homo sapiens
LKNSLFEYQKNN

SEQ ID NO: 68513 - protein, 13 aa, Homo sapiens
LKNSLFEYQKNNK

SEQ ID NO: 68514 - protein, 27 aa, Homo sapiens
LKNSLFEYQKNNKDSHSLTTNIMEILR

SEQ ID NO: 68515 - protein, 11 aa, Homo sapiens
LVTSKGDKELR

SEQ ID NO: 68516 - protein, 14 aa, Homo sapiens
LVTSKGDKELRTGK

SEQ ID NO: 68517 - protein, 16 aa, Homo sapiens
LVTSKGDKELRTGKEK

SEQ ID NO: 68518 - protein, 26 aa, Homo sapiens
LVTSKGDKELRTGKEKVTSGSTTTTR

SEQ ID NO: 68519 - protein, 15 aa, Homo sapiens
MADEAGSEADHEGTH

SEQ ID NO: 68520 - protein, 16 aa, Homo sapiens
MADEAGSEADHEGTHS

SEQ ID NO: 68521 - protein, 17 aa, Homo sapiens
MADEAGSEADHEGTHST

SEQ ID NO: 68522 - protein, 18 aa, Homo sapiens
MADEAGSEADHEGTHSTK

SEQ ID NO: 68523 - protein, 19 aa, Homo sapiens
MADEAGSEADHEGTHSTKR

SEQ ID NO: 68524 - protein, 20 aa, Homo sapiens
MADEAGSEADHEGTHSTKRG

SEQ ID NO: 68525 - protein, 23 aa, Homo sapiens
MADEAGSEADHEGTHSTKRGHAK

SEQ ID NO: 68526 - protein, 12 aa, Homo sapiens
MELERPGGNEIT

SEQ ID NO: 68527 - protein, 13 aa, Homo sapiens
MELERPGGNEITR

SEQ ID NO: 68528 - protein, 22 aa, Homo sapiens
MELERPGGNEITRGGSTSYGTG

SEQ ID NO: 68529 - protein, 29 aa, Homo sapiens
MELERPGGNEITRGGSTSYGTGSETESPR

SEQ ID NO: 68530 - protein, 12 aa, Homo sapiens
MKGLIDEVNQDF

SEQ ID NO: 68531 - protein, 15 aa, Homo sapiens
MKGLIDEVNQDFTNR

SEQ ID NO: 68532 - protein, 18 aa, Homo sapiens
MKGLIDEVNQDFTNRINK

SEQ ID NO: 68533 - protein, 20 aa, Homo sapiens
MKGLIDEVNQDFTNRINKLK

SEQ ID NO: 68534 - protein, 28 aa, Homo sapiens
MKGLIDEVNQDFTNRINKLKNSLFEYQK

SEQ ID NO: 68535 - protein, 11 aa, Homo sapiens
MKPVPDLVPGN

SEQ ID NO: 68536 - protein, 12 aa, Homo sapiens
MKPVPDLVPGNF

SEQ ID NO: 68537 - protein, 13 aa, Homo sapiens
MKPVPDLVPGNFK

SEQ ID NO: 68538 - protein, 18 aa, Homo sapiens
MKPVPDLVPGNFKSQLQK

SEQ ID NO: 68539 - protein, 24 aa, Homo sapiens
MKPVPDLVPGNFKSQLQKVPPEWK

SEQ ID NO: 68540 - protein, 33 aa, Homo sapiens
MKPVPDLVPGNFKSQLQKVPPEWKALTDMPQMR

SEQ ID NO: 68541 - protein, 12 aa, Homo sapiens
MLGEFVSETESR

SEQ ID NO: 68542 - protein, 17 aa, Homo sapiens
NNKDSHSLTTNIMEILR

SEQ ID NO: 68543 - protein, 25 aa, Homo sapiens
NNKDSHSLTTNIMEILRGDFSSANN

SEQ ID NO: 68544 - protein, 19 aa, Homo sapiens
NPDWGTFEEVSGNVSPGTR

SEQ ID NO: 68545 - protein, 14 aa, Homo sapiens
NPGSSGTGGTATWK

SEQ ID NO: 68546 - protein, 16 aa, Homo sapiens
NPGSSGTGGTATWKPG

SEQ ID NO: 68547 - protein, 20 aa, Homo sapiens
NPGSSGTGGTATWKPGSSGP

SEQ ID NO: 68548 - protein, 21 aa, Homo sapiens
NPGSSGTGGTATWKPGSSGPG

SEQ ID NO: 68549 - protein, 27 aa, Homo sapiens
NPGSSGTGGTATWKPGSSGPGSTGSWN

SEQ ID NO: 68550 - protein, 30 aa, Homo sapiens
NPGSSGTGGTATWKPGSSGPGSTGSWNSGS

SEQ ID NO: 68551 - protein, 38 aa, Homo sapiens
NPGSSGTGGTATWKPGSSGPGSTGSWNSGSSGTGSTGN

SEQ ID NO: 68552 - protein, 40 aa, Homo sapiens
NPGSSGTGGTATWKPGSSGPGSTGSWNSGSSGTGSTGNQN

SEQ ID NO: 68553 - protein, 45 aa, Homo sapiens
NPGSSGTGGTATWKPGSSGPGSTGSWNSGSSGTGSTGNQNPGSPR

SEQ ID NO: 68554 - protein, 20 aa, Homo sapiens
NPSSAGSWNSGSSGPGSTGN

SEQ ID NO: 68555 - protein, 21 aa, Homo sapiens
NPSSAGSWNSGSSGPGSTGNR

SEQ ID NO: 68556 - protein, 22 aa, Homo sapiens
NPSSAGSWNSGSSGPGSTGNRN

SEQ ID NO: 68557 - protein, 41 aa, Homo sapiens
NPSSAGSWNSGSSGPGSTGNRNPGSSGTGGTATWKPGSSGP

SEQ ID NO: 68558 - protein, 8 aa, Homo sapiens
NSLFEYQK

SEQ ID NO: 68559 - protein, 10 aa, Homo sapiens
NSLFEYQKNN

SEQ ID NO: 68560 - protein, 11 aa, Homo sapiens
NSLFEYQKNNK

SEQ ID NO: 68561 - protein, 25 aa, Homo sapiens
NSLFEYQKNNKDSHSLTTNIMEILR

SEQ ID NO: 68562 - protein, 20 aa, Homo sapiens
NTKESSSHHPGIAEFPSRGK

SEQ ID NO: 68563 - protein, 14 aa, Homo sapiens
PDEAAFFDTASTGK

SEQ ID NO: 68564 - protein, 9 aa, Homo sapiens
PDLVPGNFK

SEQ ID NO: 68565 - protein, 31 aa, Homo sapiens
PDSPGSGNARPNNPDWGTFEEVSGNVSPGTR

SEQ ID NO: 68566 - protein, 18 aa, Homo sapiens
PDWGTFEEVSGNVSPGTR

SEQ ID NO: 68567 - protein, 13 aa, Homo sapiens
PEWKALTDMPQMR

SEQ ID NO: 68568 - protein, 11 aa, Homo sapiens
PFCSDEDWNYK

SEQ ID NO: 68569 - protein, 18 aa, Homo sapiens
PGFFSPMLGEFVSETESR

SEQ ID NO: 68570 - protein, 8 aa, Homo sapiens
PGGNEITR

SEQ ID NO: 68571 - protein, 19 aa, Homo sapiens
PGSPRPGSTGTWNPGSSER

SEQ ID NO: 68572 - protein, 14 aa, Homo sapiens
PGSTGTWNPGSSER

SEQ ID NO: 68573 - protein, 13 aa, Homo sapiens
PMLGEFVSETESR

SEQ ID NO: 68574 - protein, 21 aa, Homo sapiens
PNNPDWGTFEEVSGNVSPGTR

SEQ ID NO: 68575 - protein, 14 aa, Homo sapiens
PPEWKALTDMPQMR

SEQ ID NO: 68576 - protein, 20 aa, Homo sapiens
PSGCRMKGLIDEVNQDFTNR

SEQ ID NO: 68577 - protein, 20 aa, Homo sapiens
PSSAGSWNSGSSGPGSTGNR

SEQ ID NO: 68578 - protein, 11 aa, Homo sapiens
PVPDLVPGNFK

SEQ ID NO: 68579 - protein, 10 aa, Homo sapiens
QFTSSTSYNR

SEQ ID NO: 68580 - protein, 17 aa, Homo sapiens
QFTSSTSYNRGDSTFES

SEQ ID NO: 68581 - protein, 18 aa, Homo sapiens
QFTSSTSYNRGDSTFESK

SEQ ID NO: 68582 - protein, 21 aa, Homo sapiens
QFTSSTSYNRGDSTFESKSYK

SEQ ID NO: 68583 - protein, 7 aa, Homo sapiens
QHLPLIK

SEQ ID NO: 68584 - protein, 8 aa, Homo sapiens
QLEQVIAK

SEQ ID NO: 68585 - protein, 7 aa, Homo sapiens
REYHTEK

SEQ ID NO: 68586 - protein, 12 aa, Homo sapiens
REYHTEKLVTSK

SEQ ID NO: 68587 - protein, 18 aa, Homo sapiens
REYHTEKLVTSKGDKELR

SEQ ID NO: 68588 - protein, 21 aa, Homo sapiens
REYHTEKLVTSKGDKELRTGK

SEQ ID NO: 68589 - protein, 29 aa, Homo sapiens
RGSESGIFTNTKESSSHHPGIAEFPSRGK

SEQ ID NO: 68590 - protein, 15 aa, Homo sapiens
RKVIEKVQHIQLLQK

SEQ ID NO: 68591 - protein, 8 aa, Homo sapiens
RLEVDIDI

SEQ ID NO: 68592 - protein, 9 aa, Homo sapiens
RLEVDIDIK

SEQ ID NO: 68593 - protein, 11 aa, Homo sapiens
RMDGSLNFNRT

SEQ ID NO: 68594 - protein, 18 aa, Homo sapiens
SAGSWNSGSSGPGSTGNR

SEQ ID NO: 68595 - protein, 10 aa, Homo sapiens
SESGIFTNTK

SEQ ID NO: 68596 - protein, 17 aa, Homo sapiens
SETESRGSESGIFTNTK

SEQ ID NO: 68597 - protein, 32 aa, Homo sapiens
SETESRGSESGIFTNTKESSSHHPGIAEFPSR

SEQ ID NO: 68598 - protein, 34 aa, Homo sapiens
SETESRGSESGIFTNTKESSSHHPGIAEFPSRGK

SEQ ID NO: 68599 - protein, 14 aa, Homo sapiens
SGEGDFLAEGGGVR

SEQ ID NO: 68600 - protein, 10 aa, Homo sapiens
SGIGTLDGFR

SEQ ID NO: 68601 - protein, 42 aa, Homo sapiens
SGPGSTGSWNSGSSGTGSTGNQNPGSPRPGSTGTWNPGSSER

SEQ ID NO: 68602 - protein, 32 aa, Homo sapiens
SGSSGTGSTGNQNPGSPRPGSTGTWNPGSSER

SEQ ID NO: 68603 - protein, 29 aa, Homo sapiens
SGTGSTGNQNPGSPRPGSTGTWNPGSSER

SEQ ID NO: 68604 - protein, 12 aa, Homo sapiens
SHHPGIAEFPSR

SEQ ID NO: 68605 - protein, 14 aa, Homo sapiens
SHHPGIAEFPSRGK

SEQ ID NO: 68606 - protein, 13 aa, Homo sapiens
SHSLTTNIMEILR

SEQ ID NO: 68607 - protein, 11 aa, Homo sapiens
SLTTNIMEILR

SEQ ID NO: 68608 - protein, 29 aa, Homo sapiens
SPGSGNARPNNPDWGTFEEVSGNVSPGTR

SEQ ID NO: 68609 - protein, 14 aa, Homo sapiens
SPMLGEFVSETESR

SEQ ID NO: 68610 - protein, 11 aa, Homo sapiens
SQLQKVPPEWK

SEQ ID NO: 68611 - protein, 20 aa, Homo sapiens
SQLQKVPPEWKALTDMPQMR

SEQ ID NO: 68612 - protein, 30 aa, Homo sapiens
SRGSESGIFTNTKESSSHHPGIAEFPSRGK

SEQ ID NO: 68613 - protein, 7 aa, Homo sapiens
SRIEVLK

SEQ ID NO: 68614 - protein, 8 aa, Homo sapiens
SRIEVLKR

SEQ ID NO: 68615 - protein, 19 aa, Homo sapiens
SSAGSWNSGSSGPGSTGNR

SEQ ID NO: 68616 - protein, 30 aa, Homo sapiens
SSGTGSTGNQNPGSPRPGSTGTWNPGSSER

SEQ ID NO: 68617 - protein, 13 aa, Homo sapiens
SSHHPGIAEFPSR

SEQ ID NO: 68618 - protein, 15 aa, Homo sapiens
SSHHPGIAEFPSRGK

SEQ ID NO: 68619 - protein, 14 aa, Homo sapiens
SSSHHPGIAEFPSR

SEQ ID NO: 68620 - protein, 14 aa, Homo sapiens
SSSYSKQFTSSTSY

SEQ ID NO: 68621 - protein, 16 aa, Homo sapiens
SSSYSKQFTSSTSYNR

SEQ ID NO: 68622 - protein, 21 aa, Homo sapiens
SSSYSKQFTSSTSYNRGDSTF

SEQ ID NO: 68623 - protein, 23 aa, Homo sapiens
SSSYSKQFTSSTSYNRGDSTFES

SEQ ID NO: 68624 - protein, 24 aa, Homo sapiens
SSSYSKQFTSSTSYNRGDSTFESK

SEQ ID NO: 68625 - protein, 26 aa, Homo sapiens
SSSYSKQFTSSTSYNRGDSTFESKSY

SEQ ID NO: 68626 - protein, 15 aa, Homo sapiens
SSTSYNRGDSTFESK

SEQ ID NO: 68627 - protein, 24 aa, Homo sapiens
STGKTFPGFFSPMLGEFVSETESR

SEQ ID NO: 68628 - protein, 12 aa, Homo sapiens
STGTWNPGSSER

SEQ ID NO: 68629 - protein, 14 aa, Homo sapiens
STSYGTGSETESPR

SEQ ID NO: 68630 - protein, 15 aa, Homo sapiens
SWNSGSSGPGSTGNR

SEQ ID NO: 68631 - protein, 12 aa, Homo sapiens
SYGTGSETESPR

SEQ ID NO: 68632 - protein, 18 aa, Homo sapiens
SYKMADEAGSEADHEGTH

SEQ ID NO: 68633 - protein, 20 aa, Homo sapiens
SYKMADEAGSEADHEGTHST

SEQ ID NO: 68634 - protein, 21 aa, Homo sapiens
SYKMADEAGSEADHEGTHSTK

SEQ ID NO: 68635 - protein, 22 aa, Homo sapiens
SYKMADEAGSEADHEGTHSTKR

SEQ ID NO: 68636 - protein, 25 aa, Homo sapiens
SYKMADEAGSEADHEGTHSTKRGHA

SEQ ID NO: 68637 - protein, 26 aa, Homo sapiens
SYKMADEAGSEADHEGTHSTKRGHAK

SEQ ID NO: 68638 - protein, 14 aa, Homo sapiens
TEKLVTSKGDKELR

SEQ ID NO: 68639 - protein, 16 aa, Homo sapiens
TFPGFFSPMLGEFVSE

SEQ ID NO: 68640 - protein, 20 aa, Homo sapiens
TFPGFFSPMLGEFVSETESR

SEQ ID NO: 68641 - protein, 31 aa, Homo sapiens
TFPGFFSPMLGEFVSETESRGSESGIFTNTK

SEQ ID NO: 68642 - protein, 15 aa, Homo sapiens
TGKEKVTSGSTTTTR

SEQ ID NO: 68643 - protein, 19 aa, Homo sapiens
TGTWNPGSSERGSAGHWTS

SEQ ID NO: 68644 - protein, 17 aa, Homo sapiens
TKESSSHHPGIAEFPSR

SEQ ID NO: 68645 - protein, 19 aa, Homo sapiens
TKESSSHHPGIAEFPSRGK

SEQ ID NO: 68646 - protein, 25 aa, Homo sapiens
TKESSSHHPGIAEFPSRGKSSSYSK

SEQ ID NO: 68647 - protein, 12 aa, Homo sapiens
TLSGIGTLDGFR

SEQ ID NO: 68648 - protein, 21 aa, Homo sapiens
TNTKESSSHHPGIAEFPSRGK

SEQ ID NO: 68649 - protein, 9 aa, Homo sapiens
TSGSTTTTR

SEQ ID NO: 68650 - protein, 16 aa, Homo sapiens
TSSTSYNRGDSTFESK

SEQ ID NO: 68651 - protein, 13 aa, Homo sapiens
TSYGTGSETESPR

SEQ ID NO: 68652 - protein, 9 aa, Homo sapiens
TVIGPDGHK

SEQ ID NO: 68653 - protein, 13 aa, Homo sapiens
TVIGPDGHKEVTK

SEQ ID NO: 68654 - protein, 16 aa, Homo sapiens
TVIGPDGHKEVTKEVV

SEQ ID NO: 68655 - protein, 20 aa, Homo sapiens
TVIGPDGHKEVTKEVVTSED

SEQ ID NO: 68656 - protein, 23 aa, Homo sapiens
TVIGPDGHKEVTKEVVTSEDGSD

SEQ ID NO: 68657 - protein, 13 aa, Homo sapiens
TVTKTVIGPDGHK

SEQ ID NO: 68658 - protein, 16 aa, Homo sapiens
TVTKTVIGPDGHKEVT

SEQ ID NO: 68659 - protein, 17 aa, Homo sapiens
TVTKTVIGPDGHKEVTK

SEQ ID NO: 68660 - protein, 27 aa, Homo sapiens
TVTKTVIGPDGHKEVTKEVVTSEDGSD

SEQ ID NO: 68661 - protein, 18 aa, Homo sapiens
VELEDWAGNEAYAEYHFR

SEQ ID NO: 68662 - protein, 13 aa, Homo sapiens
VIEKVQHIQLLQK

SEQ ID NO: 68663 - protein, 16 aa, Homo sapiens
VIEKVQHIQLLQKNVR

SEQ ID NO: 68664 - protein, 6 aa, Homo sapiens
VPPEWK

SEQ ID NO: 68665 - protein, 15 aa, Homo sapiens
VPPEWKALTDMPQMR

SEQ ID NO: 68666 - protein, 9 aa, Homo sapiens
VQHIQLLQK

SEQ ID NO: 68667 - protein, 12 aa, Homo sapiens
VQHIQLLQKNVR

SEQ ID NO: 68668 - protein, 6 aa, Homo sapiens
VSEDLR

SEQ ID NO: 68669 - protein, 10 aa, Homo sapiens
VTSGSTTTTR

SEQ ID NO: 68670 - protein, 11 aa, Homo sapiens
VTSGSTTTTRR

SEQ ID NO: 68671 - protein, 25 aa, Homo sapiens
VTSKGDKELRTGKEKVTSGSTTTTR

SEQ ID NO: 68672 - protein, 17 aa, Homo sapiens
WGTFEEVSGNVSPGTRR

SEQ ID NO: 68673 - protein, 14 aa, Homo sapiens
WNSGSSGPGSTGNR

SEQ ID NO: 68674 - protein, 12 aa, Homo sapiens
WPFCSDEDWNYK

SEQ ID NO: 68675 - protein, 11 aa, Homo sapiens
YGTGSETESPR

SEQ ID NO: 68676 - protein, 21 aa, Homo sapiens
YSKQFTSSTSYNRGDSTFESK

SEQ ID NO: 68677 - protein, 14 aa, Homo sapiens
GIHTSPLGKPSLSP

SEQ ID NO: 68678 - protein, 12 aa, Homo sapiens
AHYGGFTVQNEA

SEQ ID NO: 68679 - protein, 13 aa, Homo sapiens
AHYGGFTVQNEAN

SEQ ID NO: 68680 - protein, 14 aa, Homo sapiens
AHYGGFTVQNEANK

SEQ ID NO: 68681 - protein, 21 aa, Homo sapiens
AHYGGFTVQNEANKYQISVNK

SEQ ID NO: 68682 - protein, 23 aa, Homo sapiens
AHYGGFTVQNEANKYQISVNKYR

SEQ ID NO: 68683 - protein, 22 aa, Homo sapiens
APDAGGCLHADPDLGVLCPTGC

SEQ ID NO: 68684 - protein, 33 aa, Homo sapiens
APDAGGCLHADPDLGVLCPTGCQLQEALLQQER

SEQ ID NO: 68685 - protein, 36 aa, Homo sapiens
APDAGGCLHADPDLGVLCPTGCQLQEALLQQERPIR

SEQ ID NO: 68686 - protein, 17 aa, Homo sapiens
APSLRPAPPPISGGGYR

SEQ ID NO: 68687 - protein, 11 aa, Homo sapiens
ARPAKAAATQK

SEQ ID NO: 68688 - protein, 9 aa, Homo sapiens
CHAANPNGR

SEQ ID NO: 68689 - protein, 34 aa, Homo sapiens
DAGGCLHADPDLGVLCPTGCQLQEALLQQERPIR

SEQ ID NO: 68690 - protein, 6 aa, Homo sapiens
DLWQKR

SEQ ID NO: 68691 - protein, 11 aa, Homo sapiens
DNDGWLTSDPR

SEQ ID NO: 68692 - protein, 15 aa, Homo sapiens
DNENVVNEYSSELEK

SEQ ID NO: 68693 - protein, 33 aa, Homo sapiens
DNENVVNEYSSELEKHQLYIDETVNSNIPTNLR

SEQ ID NO: 68694 - protein, 7 aa, Homo sapiens
ECEEIIR

SEQ ID NO: 68695 - protein, 10 aa, Homo sapiens
EDGGGWWYNR

SEQ ID NO: 68696 - protein, 18 aa, Homo sapiens
EEAPSLRPAPPPISGGGY

SEQ ID NO: 68697 - protein, 19 aa, Homo sapiens
EEAPSLRPAPPPISGGGYR

SEQ ID NO: 68698 - protein, 17 aa, Homo sapiens
GGETSEMYLIQPDSSVK

SEQ ID NO: 68699 - protein, 19 aa, Homo sapiens
GGETSEMYLIQPDSSVKPY

SEQ ID NO: 68700 - protein, 20 aa, Homo sapiens
GGETSEMYLIQPDSSVKPYR

SEQ ID NO: 68701 - protein, 7 aa, Homo sapiens
GHRPLDK

SEQ ID NO: 68702 - protein, 8 aa, Homo sapiens
GHRPLDKK

SEQ ID NO: 68703 - protein, 9 aa, Homo sapiens
GHRPLDKKR

SEQ ID NO: 68704 - protein, 28 aa, Homo sapiens
GHRPLDKKREEAPSLRPAPPPISGGGYR

SEQ ID NO: 68705 - protein, 9 aa, Homo sapiens
GMFFSTYDR

SEQ ID NO: 68706 - protein, 13 aa, Homo sapiens
GPTELLIEMEDWK

SEQ ID NO: 68707 - protein, 7 aa, Homo sapiens
GSWYSMR

SEQ ID NO: 68708 - protein, 13 aa, Homo sapiens
GTAGNALMDGASQ

SEQ ID NO: 68709 - protein, 14 aa, Homo sapiens
GTAGNALMDGASQL

SEQ ID NO: 68710 - protein, 19 aa, Homo sapiens
GTAGNALMDGASQLMGENR

SEQ ID NO: 68711 - protein, 13 aa, Homo sapiens
GVNDNEEGFFSAR

SEQ ID NO: 68712 - protein, 13 aa, Homo sapiens
HGTDDGVVWMNWK

SEQ ID NO: 68713 - protein, 20 aa, Homo sapiens
HGTDDGVVWMNWKGSWYSMR

SEQ ID NO: 68714 - protein, 21 aa, Homo sapiens
HGTDDGVVWMNWKGSWYSMRK

SEQ ID NO: 68715 - protein, 11 aa, Homo sapiens
HQLYIDETVNS

SEQ ID NO: 68716 - protein, 18 aa, Homo sapiens
HQLYIDETVNSNIPTNLR

SEQ ID NO: 68717 - protein, 21 aa, Homo sapiens
HQLYIDETVNSNIPTNLRVLR

SEQ ID NO: 68718 - protein, 16 aa, Homo sapiens
IQKLESDVSAQMEYCR

SEQ ID NO: 68719 - protein, 8 aa, Homo sapiens
IRPFFPQQ

SEQ ID NO: 68720 - protein, 6 aa, Homo sapiens
ISQLTR

SEQ ID NO: 68721 - protein, 23 aa, Homo sapiens
KAPDAGGCLHADPDLGVLCPTGC

SEQ ID NO: 68722 - protein, 34 aa, Homo sapiens
KAPDAGGCLHADPDLGVLCPTGCQLQEALLQQER

SEQ ID NO: 68723 - protein, 37 aa, Homo sapiens
KAPDAGGCLHADPDLGVLCPTGCQLQEALLQQERPIR

SEQ ID NO: 68724 - protein, 18 aa, Homo sapiens
KGGETSEMYLIQPDSSVK

SEQ ID NO: 68725 - protein, 21 aa, Homo sapiens
KGGETSEMYLIQPDSSVKPYR

SEQ ID NO: 68726 - protein, 15 aa, Homo sapiens
KQCSKEDGGGWWYNR

SEQ ID NO: 68727 - protein, 21 aa, Homo sapiens
KREEAPSLRPAPPPISGGGYR

SEQ ID NO: 68728 - protein, 6 aa, Homo sapiens
KWDPYK

SEQ ID NO: 68729 - protein, 19 aa, Homo sapiens
KWDPYKQGFGNVATNTDGK

SEQ ID NO: 68730 - protein, 34 aa, Homo sapiens
KWDPYKQGFGNVATNTDGKNYCGLPGEYWLGNDK

SEQ ID NO: 68731 - protein, 13 aa, Homo sapiens
LESDVSAQMEYCR

SEQ ID NO: 68732 - protein, 29 aa, Homo sapiens
LHADPDLGVLCPTGCQLQEALLQQERPIR

SEQ ID NO: 68733 - protein, 12 aa, Homo sapiens
LIQPDSSVKPYR

SEQ ID NO: 68734 - protein, 14 aa, Homo sapiens
LRPAPPPISGGGYR

SEQ ID NO: 68735 - protein, 14 aa, Homo sapiens
MGPTELLIEMEDWK

SEQ ID NO: 68736 - protein, 17 aa, Homo sapiens
MGPTELLIEMEDWKGDK

SEQ ID NO: 68737 - protein, 19 aa, Homo sapiens
MGPTELLIEMEDWKGDKVK

SEQ ID NO: 68738 - protein, 11 aa, Homo sapiens
NDNEEGFFSAR

SEQ ID NO: 68739 - protein, 14 aa, Homo sapiens
NENVVNEYSSELEK

SEQ ID NO: 68740 - protein, 32 aa, Homo sapiens
NENVVNEYSSELEKHQLYIDETVNSNIPTNLR

SEQ ID NO: 68741 - protein, 30 aa, Homo sapiens
NEYSSELEKHQLYIDETVNSNIPTNLRVLR

SEQ ID NO: 68742 - protein, 10 aa, Homo sapiens
NGMFFSTYDR

SEQ ID NO: 68743 - protein, 23 aa, Homo sapiens
NSVDELNNNVEAVSQTSSSSFQY

SEQ ID NO: 68744 - protein, 25 aa, Homo sapiens
NSVDELNNNVEAVSQTSSSSFQYMY

SEQ ID NO: 68745 - protein, 28 aa, Homo sapiens
NSVDELNNNVEAVSQTSSSSFQYMYLLK

SEQ ID NO: 68746 - protein, 33 aa, Homo sapiens
NSVDELNNNVEAVSQTSSSSFQYMYLLKDLWQK

SEQ ID NO: 68747 - protein, 34 aa, Homo sapiens
NSVDELNNNVEAVSQTSSSSFQYMYLLKDLWQKR

SEQ ID NO: 68748 - protein, 15 aa, Homo sapiens
NYCGLPGEYWLGNDK

SEQ ID NO: 68749 - protein, 21 aa, Homo sapiens
NYCGLPGEYWLGNDKISQLTR

SEQ ID NO: 68750 - protein, 12 aa, Homo sapiens
PAPPPISGGGYR

SEQ ID NO: 68751 - protein, 25 aa, Homo sapiens
PDLGVLCPTGCQLQEALLQQERPIR

SEQ ID NO: 68752 - protein, 9 aa, Homo sapiens
PDSSVKPYR

SEQ ID NO: 68753 - protein, 10 aa, Homo sapiens
PGEYWLGNDK

SEQ ID NO: 68754 - protein, 16 aa, Homo sapiens
PGEYWLGNDKISQLTR

SEQ ID NO: 68755 - protein, 31 aa, Homo sapiens
PIRNSVDELNNNVEAVSQTSSSSFQYMYLLK

SEQ ID NO: 68756 - protein, 10 aa, Homo sapiens
PPPISGGGYR

SEQ ID NO: 68757 - protein, 16 aa, Homo sapiens
PSLRPAPPPISGGGYR

SEQ ID NO: 68758 - protein, 12 aa, Homo sapiens
PTELLIEMEDWK

SEQ ID NO: 68759 - protein, 14 aa, Homo sapiens
QCSKEDGGGWWYNR

SEQ ID NO: 68760 - protein, 9 aa, Homo sapiens
QDGSVDFGR

SEQ ID NO: 68761 - protein, 10 aa, Homo sapiens
QDGSVDFGRK

SEQ ID NO: 68762 - protein, 13 aa, Homo sapiens
QGFGNVATNTDGK

SEQ ID NO: 68763 - protein, 14 aa, Homo sapiens
QGVNDNEEGFFSAR

SEQ ID NO: 68764 - protein, 18 aa, Homo sapiens
QVKDNENVVNEYSSELEK

SEQ ID NO: 68765 - protein, 19 aa, Homo sapiens
REEAPSLRPAPPPISGGGY

SEQ ID NO: 68766 - protein, 20 aa, Homo sapiens
REEAPSLRPAPPPISGGGYR

SEQ ID NO: 68767 - protein, 21 aa, Homo sapiens
RGTAGNALMDGASQLMGENRT

SEQ ID NO: 68768 - protein, 7 aa, Homo sapiens
SILENLR

SEQ ID NO: 68769 - protein, 16 aa, Homo sapiens
SKIQKLESDVSAQMEY

SEQ ID NO: 68770 - protein, 18 aa, Homo sapiens
SKIQKLESDVSAQMEYCR

SEQ ID NO: 68771 - protein, 15 aa, Homo sapiens
SLRPAPPPISGGGYR

SEQ ID NO: 68772 - protein, 15 aa, Homo sapiens
SQTSSSSFQYMYLLK

SEQ ID NO: 68773 - protein, 25 aa, Homo sapiens
TDGKNYCGLPGEYWLGNDKISQLTR

SEQ ID NO: 68774 - protein, 16 aa, Homo sapiens
TELLIEMEDWKGDKVK

SEQ ID NO: 68775 - protein, 13 aa, Homo sapiens
TIHNGMFFSTYDR

SEQ ID NO: 68776 - protein, 13 aa, Homo sapiens
TMTIHNGMFFSTY

SEQ ID NO: 68777 - protein, 15 aa, Homo sapiens
TMTIHNGMFFSTYDR

SEQ ID NO: 68778 - protein, 26 aa, Homo sapiens
TMTIHNGMFFSTYDRDNDGWLTSDPR

SEQ ID NO: 68779 - protein, 27 aa, Homo sapiens
TMTIHNGMFFSTYDRDNDGWLTSDPRK

SEQ ID NO: 68780 - protein, 15 aa, Homo sapiens
TPCTVSCNIPVVSGK

SEQ ID NO: 68781 - protein, 22 aa, Homo sapiens
TPCTVSCNIPVVSGKECEEIIR

SEQ ID NO: 68782 - protein, 23 aa, Homo sapiens
TPCTVSCNIPVVSGKECEEIIRK

SEQ ID NO: 68783 - protein, 12 aa, Homo sapiens
TVSCNIPVVSGK

SEQ ID NO: 68784 - protein, 16 aa, Homo sapiens
VKAHYGGFTVQNEANK

SEQ ID NO: 68785 - protein, 10 aa, Homo sapiens
VLRSILENLR

SEQ ID NO: 68786 - protein, 12 aa, Homo sapiens
VNDNEEGFFSAR

SEQ ID NO: 68787 - protein, 31 aa, Homo sapiens
VNEYSSELEKHQLYIDETVNSNIPTNLRVLR

SEQ ID NO: 68788 - protein, 18 aa, Homo sapiens
VYCDMNTENGGWTVIQNR

SEQ ID NO: 68789 - protein, 18 aa, Homo sapiens
WDPYKQGFGNVATNTDGK

SEQ ID NO: 68790 - protein, 15 aa, Homo sapiens
YIDETVNSNIPTNLR

SEQ ID NO: 68791 - protein, 13 aa, Homo sapiens
YLIQPDSSVKPYR

SEQ ID NO: 68792 - protein, 7 aa, Homo sapiens
YQISVNK

SEQ ID NO: 68793 - protein, 9 aa, Homo sapiens
YQISVNKYR

SEQ ID NO: 68794 - protein, 21 aa, Homo sapiens
YRGTAGNALMDGASQLMGENR

SEQ ID NO: 68795 - protein, 8 aa, Homo sapiens
YYWGGQYT

SEQ ID NO: 68796 - protein, 13 aa, Homo sapiens
YYWGGQYTWDMAK

SEQ ID NO: 68797 - protein, 10 aa, Homo sapiens
ADFLSTYQTK

SEQ ID NO: 68798 - protein, 13 aa, Homo sapiens
AIQLTYNPDESSK

SEQ ID NO: 68799 - protein, 15 aa, Homo sapiens
AIQLTYNPDESSKPN

SEQ ID NO: 68800 - protein, 23 aa, Homo sapiens
AIQLTYNPDESSKPNMIDAATLK

SEQ ID NO: 68801 - protein, 23 aa, Homo sapiens
ANQQFLVYCEIDGSGNGWTVFQK

SEQ ID NO: 68802 - protein, 17 aa, Homo sapiens
ASTPNGYDNGIIWATWK

SEQ ID NO: 68803 - protein, 19 aa, Homo sapiens
ASTPNGYDNGIIWATWKTR

SEQ ID NO: 68804 - protein, 18 aa, Homo sapiens
CHAGHLNGVYYQGGTYSK

SEQ ID NO: 68805 - protein, 8 aa, Homo sapiens
DCQDIANK

SEQ ID NO: 68806 - protein, 11 aa, Homo sapiens
DCQDIANKGAK

SEQ ID NO: 68807 - protein, 13 aa, Homo sapiens
DKYRLTYAYFAGG

SEQ ID NO: 68808 - protein, 15 aa, Homo sapiens
DLQSLEDILHQVENK

SEQ ID NO: 68809 - protein, 9 aa, Homo sapiens
DNCCILDER

SEQ ID NO: 68810 - protein, 30 aa, Homo sapiens
DNCCILDERFGSYCPTTCGIADFLSTYQTK

SEQ ID NO: 68811 - protein, 11 aa, Homo sapiens
DTVQIHDITGK

SEQ ID NO: 68812 - protein, 14 aa, Homo sapiens
EGFGHLSPTGTTEF

SEQ ID NO: 68813 - protein, 20 aa, Homo sapiens
EGFGHLSPTGTTEFWLGNEK

SEQ ID NO: 68814 - protein, 21 aa, Homo sapiens
FGSYCPTTCGIADFLSTYQTK

SEQ ID NO: 68815 - protein, 15 aa, Homo sapiens
IHLISTQSAIPYALR

SEQ ID NO: 68816 - protein, 6 aa, Homo sapiens
IIPFNR

SEQ ID NO: 68817 - protein, 7 aa, Homo sapiens
IVNLKEK

SEQ ID NO: 68818 - protein, 16 aa, Homo sapiens
KDLQSLEDILHQVENK

SEQ ID NO: 68819 - protein, 17 aa, Homo sapiens
KDLQSLEDILHQVENKT

SEQ ID NO: 68820 - protein, 8 aa, Homo sapiens
KMLEEIMK

SEQ ID NO: 68821 - protein, 7 aa, Homo sapiens
KNWIQYK

SEQ ID NO: 68822 - protein, 8 aa, Homo sapiens
LDGSVDFK

SEQ ID NO: 68823 - protein, 9 aa, Homo sapiens
LDGSVDFKK

SEQ ID NO: 68824 - protein, 15 aa, Homo sapiens
LTIGEGQQHHLGGAK

SEQ ID NO: 68825 - protein, 27 aa, Homo sapiens
LTYAYFAGGDAGDAFDGFDFGDDPSDK

SEQ ID NO: 68826 - protein, 7 aa, Homo sapiens
MLEEIMK

SEQ ID NO: 68827 - protein, 20 aa, Homo sapiens
MLEEIMKYEASILTHDSSIR

SEQ ID NO: 68828 - protein, 6 aa, Homo sapiens
NWIQYK

SEQ ID NO: 68829 - protein, 11 aa, Homo sapiens
QSGLYFIKPLK

SEQ ID NO: 68830 - protein, 9 aa, Homo sapiens
RLDGSVDFK

SEQ ID NO: 68831 - protein, 10 aa, Homo sapiens
RLDGSVDFKK

SEQ ID NO: 68832 - protein, 16 aa, Homo sapiens
SAIPYALRVELEDWNG

SEQ ID NO: 68833 - protein, 12 aa, Homo sapiens
SLEDILHQVENK

SEQ ID NO: 68834 - protein, 15 aa, Homo sapiens
TRWYSMKKTTMKIIP

SEQ ID NO: 68835 - protein, 10 aa, Homo sapiens
TSTADYAMFK

SEQ ID NO: 68836 - protein, 13 aa, Homo sapiens
VAQLEAQCQEPCK

SEQ ID NO: 68837 - protein, 24 aa, Homo sapiens
VAQLEAQCQEPCKDTVQIHDITGK

SEQ ID NO: 68838 - protein, 32 aa, Homo sapiens
VAQLEAQCQEPCKDTVQIHDITGKDCQDIANK

SEQ ID NO: 68839 - protein, 10 aa, Homo sapiens
VDKDLQSLED

SEQ ID NO: 68840 - protein, 18 aa, Homo sapiens
VDKDLQSLEDILHQVENK

SEQ ID NO: 68841 - protein, 23 aa, Homo sapiens
VDKDLQSLEDILHQVENKTSEVK

SEQ ID NO: 68842 - protein, 9 aa, Homo sapiens
VELEDWNGR

SEQ ID NO: 68843 - protein, 7 aa, Homo sapiens
VGPEADK

SEQ ID NO: 68844 - protein, 9 aa, Homo sapiens
VGPEADKYR

SEQ ID NO: 68845 - protein, 13 aa, Homo sapiens
YEASILTHDSSIR

SEQ ID NO: 68846 - protein, 14 aa, Homo sapiens
YFIKPLKANQQFLV

SEQ ID NO: 68847 - protein, 12 aa, Homo sapiens
YLQEIYNSNNQK

SEQ ID NO: 68848 - protein, 14 aa, Homo sapiens
AFDGFDFGDDPSDK

SEQ ID NO: 68849 - protein, 21 aa, Homo sapiens
AGGDAGDAFDGFDFGDDPSDK

SEQ ID NO: 68850 - protein, 20 aa, Homo sapiens
AIQLTYNPDESSKPNMIDAA

SEQ ID NO: 68851 - protein, 21 aa, Homo sapiens
AIQLTYNPDESSKPNMIDAAT

SEQ ID NO: 68852 - protein, 25 aa, Homo sapiens
AIQLTYNPDESSKPNMIDAATLKSR

SEQ ID NO: 68853 - protein, 26 aa, Homo sapiens
AIQLTYNPDESSKPNMIDAATLKSRK

SEQ ID NO: 68854 - protein, 19 aa, Homo sapiens
AQCQEPCKDTVQIHDITGK

SEQ ID NO: 68855 - protein, 23 aa, Homo sapiens
AQLEAQCQEPCKDTVQIHDITGK

SEQ ID NO: 68856 - protein, 11 aa, Homo sapiens
ASILTHDSSIR

SEQ ID NO: 68857 - protein, 24 aa, Homo sapiens
AYFAGGDAGDAFDGFDFGDDPSDK

SEQ ID NO: 68858 - protein, 7 aa, Homo sapiens
CCILDER

SEQ ID NO: 68859 - protein, 16 aa, Homo sapiens
CHAGHLNGVYYQGGTY

SEQ ID NO: 68860 - protein, 12 aa, Homo sapiens
DGFDFGDDPSDK

SEQ ID NO: 68861 - protein, 20 aa, Homo sapiens
EAQCQEPCKDTVQIHDITGK

SEQ ID NO: 68862 - protein, 12 aa, Homo sapiens
EASILTHDSSIR

SEQ ID NO: 68863 - protein, 35 aa, Homo sapiens
EGFGHLSPTGTTEFWLGNEKIHLISTQSAIPYALR

SEQ ID NO: 68864 - protein, 22 aa, Homo sapiens
FAGGDAGDAFDGFDFGDDPSDK

SEQ ID NO: 68865 - protein, 19 aa, Homo sapiens
FFTSHNGMQFSTWDNDNDK

SEQ ID NO: 68866 - protein, 23 aa, Homo sapiens
FFTSHNGMQFSTWDNDNDKFEGN

SEQ ID NO: 68867 - protein, 18 aa, Homo sapiens
FGSYCPTTCGIADFLSTY

SEQ ID NO: 68868 - protein, 12 aa, Homo sapiens
GEGQQHHLGGAK

SEQ ID NO: 68869 - protein, 17 aa, Homo sapiens
GHLSPTGTTEFWLGNEK

SEQ ID NO: 68870 - protein, 12 aa, Homo sapiens
GIADFLSTYQTK

SEQ ID NO: 68871 - protein, 9 aa, Homo sapiens
GLYFIKPLK

SEQ ID NO: 68872 - protein, 11 aa, Homo sapiens
GTTEFWLGNEK

SEQ ID NO: 68873 - protein, 11 aa, Homo sapiens
GVYYQGGTYSK

SEQ ID NO: 68874 - protein, 12 aa, Homo sapiens
GYDNGIIWATWK

SEQ ID NO: 68875 - protein, 14 aa, Homo sapiens
HLISTQSAIPYALR

SEQ ID NO: 68876 - protein, 13 aa, Homo sapiens
IGEGQQHHLGGAK

SEQ ID NO: 68877 - protein, 8 aa, Homo sapiens
IHLISTQS

SEQ ID NO: 68878 - protein, 12 aa, Homo sapiens
IHLISTQSAIPY

SEQ ID NO: 68879 - protein, 24 aa, Homo sapiens
IHLISTQSAIPYALRVELEDWNGR

SEQ ID NO: 68880 - protein, 9 aa, Homo sapiens
ILTHDSSIR

SEQ ID NO: 68881 - protein, 21 aa, Homo sapiens
KMLEEIMKYEASILTHDSSIR

SEQ ID NO: 68882 - protein, 14 aa, Homo sapiens
KYEASILTHDSSIR

SEQ ID NO: 68883 - protein, 21 aa, Homo sapiens
LEAQCQEPCKDTVQIHDITGK

SEQ ID NO: 68884 - protein, 15 aa, Homo sapiens
LSPTGTTEFWLGNEK

SEQ ID NO: 68885 - protein, 23 aa, Homo sapiens
LTYAYFAGGDAGDAFDGFDFGDD

SEQ ID NO: 68886 - protein, 33 aa, Homo sapiens
LTYAYFAGGDAGDAFDGFDFGDDPSDKFFTSHN

SEQ ID NO: 68887 - protein, 20 aa, Homo sapiens
LTYNPDESSKPNMIDAATLK

SEQ ID NO: 68888 - protein, 22 aa, Homo sapiens
LTYNPDESSKPNMIDAATLKSR

SEQ ID NO: 68889 - protein, 17 aa, Homo sapiens
NPDESSKPNMIDAATLK

SEQ ID NO: 68890 - protein, 26 aa, Homo sapiens
NWIQYKEGFGHLSPTGTTEFWLGNEK

SEQ ID NO: 68891 - protein, 14 aa, Homo sapiens
PCKDTVQIHDITGK

SEQ ID NO: 68892 - protein, 16 aa, Homo sapiens
PDESSKPNMIDAATLK

SEQ ID NO: 68893 - protein, 18 aa, Homo sapiens
PDESSKPNMIDAATLKSR

SEQ ID NO: 68894 - protein, 19 aa, Homo sapiens
PFNRLTIGEGQQHHLGGAK

SEQ ID NO: 68895 - protein, 14 aa, Homo sapiens
PNGYDNGIIWATWK

SEQ ID NO: 68896 - protein, 16 aa, Homo sapiens
PTTCGIADFLSTYQTK

SEQ ID NO: 68897 - protein, 18 aa, Homo sapiens
QVRPEHPAETEYDSLYPE

SEQ ID NO: 68898 - protein, 21 aa, Homo sapiens
QVRPEHPAETEYDSLYPEDDL

SEQ ID NO: 68899 - protein, 16 aa, Homo sapiens
RLDGSVDFKKNWIQYK

SEQ ID NO: 68900 - protein, 10 aa, Homo sapiens
SGLYFIKPLK

SEQ ID NO: 68901 - protein, 10 aa, Homo sapiens
SILTHDSSIR

SEQ ID NO: 68902 - protein, 26 aa, Homo sapiens
STWDNDNDKFEGNCAEQDGSGWWMNK

SEQ ID NO: 68903 - protein, 19 aa, Homo sapiens
SYCPTTCGIADFLSTYQTK

SEQ ID NO: 68904 - protein, 14 aa, Homo sapiens
TIGEGQQHHLGGAK

SEQ ID NO: 68905 - protein, 9 aa, Homo sapiens
TSEVKQLIK

SEQ ID NO: 68906 - protein, 19 aa, Homo sapiens
TSTADYAMFKVGPEADKYR

SEQ ID NO: 68907 - protein, 19 aa, Homo sapiens
TYNPDESSKPNMIDAATLK

SEQ ID NO: 68908 - protein, 21 aa, Homo sapiens
TYNPDESSKPNMIDAATLKSR

SEQ ID NO: 68909 - protein, 35 aa, Homo sapiens
VAQLEAQCQEPCKDTVQIHDITGKDCQDIANKGAK

SEQ ID NO: 68910 - protein, 10 aa, Homo sapiens
YLQEIYNSNN

SEQ ID NO: 68911 - protein, 17 aa, Homo sapiens
YLQEIYNSNNQKIVNLK

SEQ ID NO: 68912 - protein, 19 aa, Homo sapiens
YLQEIYNSNNQKIVNLKEK

SEQ ID NO: 68913 - protein, 32 aa, Homo sapiens
KSVFSNSSKEMMCFPDFPFPDDFPNFMHNSKI

SEQ ID NO: 68914 - protein, 16 aa, Homo sapiens
AAQLPELPDVELPTNK

SEQ ID NO: 68915 - protein, 12 aa, Homo sapiens
ADYSENTFTEYK

SEQ ID NO: 68916 - protein, 13 aa, Homo sapiens
AKLPDATPTELAK

SEQ ID NO: 68917 - protein, 15 aa, Homo sapiens
AQLPELPDVELPTNK

SEQ ID NO: 68918 - protein, 12 aa, Homo sapiens
CCESASEDCMAK

SEQ ID NO: 68919 - protein, 9 aa, Homo sapiens
DVCDPGNTK

SEQ ID NO: 68920 - protein, 15 aa, Homo sapiens
DVLPLAEDITNILSK

SEQ ID NO: 68921 - protein, 11 aa, Homo sapiens
DYSENTFTEYK

SEQ ID NO: 68922 - protein, 11 aa, Homo sapiens
EDFTSLSLVLY

SEQ ID NO: 68923 - protein, 13 aa, Homo sapiens
EDFTSLSLVLYSR

SEQ ID NO: 68924 - protein, 7 aa, Homo sapiens
EFSHLGK

SEQ ID NO: 68925 - protein, 13 aa, Homo sapiens
EFSHLGKEDFTSL

SEQ ID NO: 68926 - protein, 20 aa, Homo sapiens
EFSHLGKEDFTSLSLVLYSR

SEQ ID NO: 68927 - protein, 8 aa, Homo sapiens
ELPEHTVK

SEQ ID NO: 68928 - protein, 16 aa, Homo sapiens
ELPEHTVKLCDNLSTK

SEQ ID NO: 68929 - protein, 8 aa, Homo sapiens
ELSSFIDK

SEQ ID NO: 68930 - protein, 25 aa, Homo sapiens
ELSSFIDKGQELCADYSENTFTEYK

SEQ ID NO: 68931 - protein, 26 aa, Homo sapiens
ELSSFIDKGQELCADYSENTFTEYKK

SEQ ID NO: 68932 - protein, 27 aa, Homo sapiens
ELSSFIDKGQELCADYSENTFTEYKKK

SEQ ID NO: 68933 - protein, 31 aa, Homo sapiens
ELSSFIDKGQELCADYSENTFTEYKKKLAER

SEQ ID NO: 68934 - protein, 33 aa, Homo sapiens
ELSSFIDKGQELCADYSENTFTEYKKKLAERLK

SEQ ID NO: 68935 - protein, 22 aa, Homo sapiens
EVVSLTEACCAEGADPDCYDTR

SEQ ID NO: 68936 - protein, 10 aa, Homo sapiens
EYANQFMWEY

SEQ ID NO: 68937 - protein, 13 aa, Homo sapiens
EYANQFMWEYSTN

SEQ ID NO: 68938 - protein, 19 aa, Homo sapiens
EYANQFMWEYSTNYGQAPL

SEQ ID NO: 68939 - protein, 25 aa, Homo sapiens
EYANQFMWEYSTNYGQAPLSLLVSY

SEQ ID NO: 68940 - protein, 27 aa, Homo sapiens
EYANQFMWEYSTNYGQAPLSLLVSYTK

SEQ ID NO: 68941 - protein, 8 aa, Homo sapiens
FEDCCQEK

SEQ ID NO: 68942 - protein, 19 aa, Homo sapiens
FMPAAQLPELPDVELPTNK

SEQ ID NO: 68943 - protein, 14 aa, Homo sapiens
FPSGTFEQVSQLVK

SEQ ID NO: 68944 - protein, 6 aa, Homo sapiens
GPLLKK

SEQ ID NO: 68945 - protein, 32 aa, Homo sapiens
GPLLKKELSSFIDKGQELCADYSENTFTEYKK

SEQ ID NO: 68946 - protein, 33 aa, Homo sapiens
GPLLKKELSSFIDKGQELCADYSENTFTEYKKK

SEQ ID NO: 68947 - protein, 13 aa, Homo sapiens
GQAPLSLLVSYTK

SEQ ID NO: 68948 - protein, 17 aa, Homo sapiens
GQELCADYSENTFTEYK

SEQ ID NO: 68949 - protein, 18 aa, Homo sapiens
GQELCADYSENTFTEYKK

SEQ ID NO: 68950 - protein, 31 aa, Homo sapiens
GRDYEKNKVCKEFSHLGKEDFTSLSLVLYSR

SEQ ID NO: 68951 - protein, 10 aa, Homo sapiens
HLSLLTTLSN

SEQ ID NO: 68952 - protein, 11 aa, Homo sapiens
HLSLLTTLSNR

SEQ ID NO: 68953 - protein, 13 aa, Homo sapiens
HQPQEFPTYVEPT

SEQ ID NO: 68954 - protein, 15 aa, Homo sapiens
HQPQEFPTYVEPTND

SEQ ID NO: 68955 - protein, 22 aa, Homo sapiens
HQPQEFPTYVEPTNDEICEAFR

SEQ ID NO: 68956 - protein, 23 aa, Homo sapiens
HQPQEFPTYVEPTNDEICEAFRK

SEQ ID NO: 68957 - protein, 26 aa, Homo sapiens
HQPQEFPTYVEPTNDEICEAFRKDPK

SEQ ID NO: 68958 - protein, 9 aa, Homo sapiens
KELSSFIDK

SEQ ID NO: 68959 - protein, 26 aa, Homo sapiens
KELSSFIDKGQELCADYSENTFTEYK

SEQ ID NO: 68960 - protein, 15 aa, Homo sapiens
KFPSGTFEQVSQLVK

SEQ ID NO: 68961 - protein, 10 aa, Homo sapiens
KLCDNLSTKN

SEQ ID NO: 68962 - protein, 8 aa, Homo sapiens
KLCMAALK

SEQ ID NO: 68963 - protein, 26 aa, Homo sapiens
LAQKVPTADLEDVLPLAEDITNILSK

SEQ ID NO: 68964 - protein, 8 aa, Homo sapiens
LCDNLSTK

SEQ ID NO: 68965 - protein, 17 aa, Homo sapiens
LEDVLPLAEDITNILSK

SEQ ID NO: 68966 - protein, 11 aa, Homo sapiens
LPDATPTELAK

SEQ ID NO: 68967 - protein, 10 aa, Homo sapiens
LPDVELPTNK

SEQ ID NO: 68968 - protein, 13 aa, Homo sapiens
LPELPDVELPTNK

SEQ ID NO: 68969 - protein, 13 aa, Homo sapiens
LPLAEDITNILSK

SEQ ID NO: 68970 - protein, 10 aa, Homo sapiens
LSLLTTLSNR

SEQ ID NO: 68971 - protein, 6 aa, Homo sapiens
LSNLIK

SEQ ID NO: 68972 - protein, 10 aa, Homo sapiens
LSNLIKLAQK

SEQ ID NO: 68973 - protein, 18 aa, Homo sapiens
MPAAQLPELPDVELPTNK

SEQ ID NO: 68974 - protein, 21 aa, Homo sapiens
MWEYSTNYGQAPLSLLVSYTK

SEQ ID NO: 68975 - protein, 25 aa, Homo sapiens
NKVCKEFSHLGKEDFTSLSLVLYSR

SEQ ID NO: 68976 - protein, 11 aa, Homo sapiens
NSKFEDCCQEK

SEQ ID NO: 68977 - protein, 17 aa, Homo sapiens
PAAQLPELPDVELPTNK

SEQ ID NO: 68978 - protein, 12 aa, Homo sapiens
PELPDVELPTNK

SEQ ID NO: 68979 - protein, 14 aa, Homo sapiens
PEVFLSKVLEPTLK

SEQ ID NO: 68980 - protein, 12 aa, Homo sapiens
PLAEDITNILSK

SEQ ID NO: 68981 - protein, 14 aa, Homo sapiens
PPLYCDSEIDAELK

SEQ ID NO: 68982 - protein, 13 aa, Homo sapiens
PSGTFEQVSQLVK

SEQ ID NO: 68983 - protein, 21 aa, Homo sapiens
PTADLEDVLPLAEDITNILSK

SEQ ID NO: 68984 - protein, 11 aa, Homo sapiens
PTNDEICEAFR

SEQ ID NO: 68985 - protein, 9 aa, Homo sapiens
RTHLPEVFL

SEQ ID NO: 68986 - protein, 11 aa, Homo sapiens
RTHLPEVFLSK

SEQ ID NO: 68987 - protein, 18 aa, Homo sapiens
RTHLPEVFLSKVLEPTLK

SEQ ID NO: 68988 - protein, 20 aa, Homo sapiens
SCESNSPFPVHPGTAECCTK

SEQ ID NO: 68989 - protein, 25 aa, Homo sapiens
SCESNSPFPVHPGTAECCTKEGLER

SEQ ID NO: 68990 - protein, 26 aa, Homo sapiens
SDFASNCCSINSPPLYCDSEIDAELK

SEQ ID NO: 68991 - protein, 29 aa, Homo sapiens
SDFASNCCSINSPPLYCDSEIDAELKNIL

SEQ ID NO: 68992 - protein, 12 aa, Homo sapiens
SGTFEQVSQLVK

SEQ ID NO: 68993 - protein, 18 aa, Homo sapiens
SINSPPLYCDSEIDAELK

SEQ ID NO: 68994 - protein, 18 aa, Homo sapiens
SLGECCDVEDSTTCFNAK

SEQ ID NO: 68995 - protein, 19 aa, Homo sapiens
SLGECCDVEDSTTCFNAKG

SEQ ID NO: 68996 - protein, 24 aa, Homo sapiens
SLGECCDVEDSTTCFNAKGPLLKK

SEQ ID NO: 68997 - protein, 9 aa, Homo sapiens
SLLTTLSNR

SEQ ID NO: 68998 - protein, 15 aa, Homo sapiens
SPPLYCDSEIDAELK

SEQ ID NO: 68999 - protein, 24 aa, Homo sapiens
SSFIDKGQELCADYSENTFTEYKK

SEQ ID NO: 69000 - protein, 17 aa, Homo sapiens
STNYGQAPLSLLVSYTK

SEQ ID NO: 69001 - protein, 21 aa, Homo sapiens
SYLSMVGSCCTSASPTVCFLK

SEQ ID NO: 69002 - protein, 20 aa, Homo sapiens
TADLEDVLPLAEDITNILSK

SEQ ID NO: 69003 - protein, 29 aa, Homo sapiens
TAMDVFVCTYFMPAAQLPELPDVELPTNK

SEQ ID NO: 69004 - protein, 10 aa, Homo sapiens
THLPEVFLSK

SEQ ID NO: 69005 - protein, 17 aa, Homo sapiens
THLPEVFLSKVLEPTLK

SEQ ID NO: 69006 - protein, 7 aa, Homo sapiens
TSALSAK

SEQ ID NO: 69007 - protein, 21 aa, Homo sapiens
TYFMPAAQLPELPDVELPTNK

SEQ ID NO: 69008 - protein, 23 aa, Homo sapiens
VCKEFSHLGKEDFTSLSLVLYSR

SEQ ID NO: 69009 - protein, 11 aa, Homo sapiens
VCSQYAAYGEK

SEQ ID NO: 69010 - protein, 12 aa, Homo sapiens
VCSQYAAYGEKK

SEQ ID NO: 69011 - protein, 7 aa, Homo sapiens
VLEPTLK

SEQ ID NO: 69012 - protein, 31 aa, Homo sapiens
VLEPTLKSLGECCDVEDSTTCFNAKGPLLKK

SEQ ID NO: 69013 - protein, 11 aa, Homo sapiens
VMDKYTFELSR

SEQ ID NO: 69014 - protein, 18 aa, Homo sapiens
VPTADLEDVLPLAEDITN

SEQ ID NO: 69015 - protein, 20 aa, Homo sapiens
VPTADLEDVLPLAEDITNIL

SEQ ID NO: 69016 - protein, 22 aa, Homo sapiens
VPTADLEDVLPLAEDITNILSK

SEQ ID NO: 69017 - protein, 20 aa, Homo sapiens
WEYSTNYGQAPLSLLVSYTK

SEQ ID NO: 69018 - protein, 20 aa, Homo sapiens
YFMPAAQLPELPDVELPTNK

SEQ ID NO: 69019 - protein, 14 aa, Homo sapiens
YGQAPLSLLVSYTK

SEQ ID NO: 69020 - protein, 10 aa, Homo sapiens
YSENTFTEYK

SEQ ID NO: 69021 - protein, 7 aa, Homo sapiens
YTFELSR

SEQ ID NO: 69022 - protein, 12 aa, Homo sapiens
DEIPHNDIALLK

SEQ ID NO: 69023 - protein, 18 aa, Homo sapiens
DGTYYVYGIVSWGLECGK

SEQ ID NO: 69024 - protein, 9 aa, Homo sapiens
EEFHEQSFR

SEQ ID NO: 69025 - protein, 18 aa, Homo sapiens
FCEIGSDDCYVGDGYSYR

SEQ ID NO: 69026 - protein, 10 aa, Homo sapiens
FTCACPDQFK

SEQ ID NO: 69027 - protein, 13 aa, Homo sapiens
GQCLITQSPPYYR

SEQ ID NO: 69028 - protein, 16 aa, Homo sapiens
HPYTGPSCSQVVPVCR

SEQ ID NO: 69029 - protein, 6 aa, Homo sapiens
IYGGFK

SEQ ID NO: 69030 - protein, 10 aa, Homo sapiens
KEEFHEQSFR

SEQ ID NO: 69031 - protein, 10 aa, Homo sapiens
LIANTLCNSR

SEQ ID NO: 69032 - protein, 13 aa, Homo sapiens
LKPVDGHCALESK

SEQ ID NO: 69033 - protein, 16 aa, Homo sapiens
LKPVDGHCALESKYVK

SEQ ID NO: 69034 - protein, 9 aa, Homo sapiens
LPGFDSCGK

SEQ ID NO: 69035 - protein, 13 aa, Homo sapiens
NPDADEKPWCFIK

SEQ ID NO: 69036 - protein, 18 aa, Homo sapiens
PGQDTCQGDSGGPLTCEK

SEQ ID NO: 69037 - protein, 9 aa, Homo sapiens
PGVYTQVTK

SEQ ID NO: 69038 - protein, 11 aa, Homo sapiens
PVDGHCALESK

SEQ ID NO: 69039 - protein, 19 aa, Homo sapiens
QLYDHMIDDSMICAGNLQK

SEQ ID NO: 69040 - protein, 10 aa, Homo sapiens
RPGVYTQVTK

SEQ ID NO: 69041 - protein, 9 aa, Homo sapiens
VVLGDQDLK

SEQ ID NO: 69042 - protein, 7 aa, Homo sapiens
YSHYNER

SEQ ID NO: 69043 - protein, 19 aa, Homo sapiens
YSHYNERDEIPHNDIALLK

SEQ ID NO: 69044 - protein, 14 aa, Homo sapiens
MVTAVASALSSRYH

SEQ ID NO: 69045 - protein, 10 aa, Homo sapiens
CFLGNGTGYR

SEQ ID NO: 69046 - protein, 21 aa, Homo sapiens
CQIAGWGHLDENVSGYSSSLR

SEQ ID NO: 69047 - protein, 10 aa, Homo sapiens
DSALSWEYCR

SEQ ID NO: 69048 - protein, 10 aa, Homo sapiens
DSVSVVLGQH

SEQ ID NO: 69049 - protein, 14 aa, Homo sapiens
DSVSVVLGQHFFNR

SEQ ID NO: 69050 - protein, 11 aa, Homo sapiens
EALVPLVADHK

SEQ ID NO: 69051 - protein, 9 aa, Homo sapiens
LCNIEPDER

SEQ ID NO: 69052 - protein, 19 aa, Homo sapiens
LCNIEPDERCFLGNGTGYR

SEQ ID NO: 69053 - protein, 32 aa, Homo sapiens
LCNIEPDERCFLGNGTGYRGVASTSASGLSCL

SEQ ID NO: 69054 - protein, 9 aa, Homo sapiens
LEACESLTR

SEQ ID NO: 69055 - protein, 9 aa, Homo sapiens
LHKPGVYTR

SEQ ID NO: 69056 - protein, 13 aa, Homo sapiens
MLHACTSEGSAHR

SEQ ID NO: 69057 - protein, 14 aa, Homo sapiens
NPDNDERPWCYVVK

SEQ ID NO: 69058 - protein, 12 aa, Homo sapiens
RCFLGNGTGYRG

SEQ ID NO: 69059 - protein, 16 aa, Homo sapiens
RDSVSVVLGQHFFNRT

SEQ ID NO: 69060 - protein, 16 aa, Homo sapiens
SDACQGDSGGPLACEK

SEQ ID NO: 69061 - protein, 21 aa, Homo sapiens
SQFVQPICLPEPGSTFPAGHK

SEQ ID NO: 69062 - protein, 14 aa, Homo sapiens
SVFNPSDHDLVLIR

SEQ ID NO: 69063 - protein, 11 aa, Homo sapiens
SVVLGQHFFNR

SEQ ID NO: 69064 - protein, 6 aa, Homo sapiens
TFLRPR

SEQ ID NO: 69065 - protein, 17 aa, Homo sapiens
TLYSVFNPSDHDLVLIR

SEQ ID NO: 69066 - protein, 12 aa, Homo sapiens
TTDVTQTFGIEK

SEQ ID NO: 69067 - protein, 11 aa, Homo sapiens
VANYVDWINDR

SEQ ID NO: 69068 - protein, 19 aa, Homo sapiens
VQLSPDLLATLPEPASPGR

SEQ ID NO: 69069 - protein, 10 aa, Homo sapiens
WCATTHNYDR

SEQ ID NO: 69070 - protein, 9 aa, Homo sapiens
YEYLEGGDR

SEQ ID NO: 69071 - protein, 21 aa, Homo sapiens
YIPYTLYSVFNPSDHDLVLIR

SEQ ID NO: 69072 - protein, 8 aa, Homo sapiens
YVDWINDR

SEQ ID NO: 69073 - protein, 21 aa, Homo sapiens
ADDGCPKPPEIAHGYVEHSVR

SEQ ID NO: 69074 - protein, 25 aa, Homo sapiens
AGSAFAVHDLEEDTWYATGILSFDK

SEQ ID NO: 69075 - protein, 10 aa, Homo sapiens
AHGYVEHSVR

SEQ ID NO: 69076 - protein, 10 aa, Homo sapiens
ANFKFTDHLK

SEQ ID NO: 69077 - protein, 28 aa, Homo sapiens
AVGDKLPECEADDGCPKPPEIAHGYVEH

SEQ ID NO: 69078 - protein, 31 aa, Homo sapiens
AVGDKLPECEADDGCPKPPEIAHGYVEHSVR

SEQ ID NO: 69079 - protein, 20 aa, Homo sapiens
AVHDLEEDTWYATGILSFDK

SEQ ID NO: 69080 - protein, 21 aa, Homo sapiens
CLPSKDYAEVGRVGYVSGWGR

SEQ ID NO: 69081 - protein, 17 aa, Homo sapiens
CPKPPEIAHGYVEHSVR

SEQ ID NO: 69082 - protein, 26 aa, Homo sapiens
DAGSAFAVHDLEEDTWYATGILSFDK

SEQ ID NO: 69083 - protein, 20 aa, Homo sapiens
DDGCPKPPEIAHGYVEHSVR

SEQ ID NO: 69084 - protein, 23 aa, Homo sapiens
DIADDGCPKPPEIAHGYVEHSVR

SEQ ID NO: 69085 - protein, 17 aa, Homo sapiens
DLEEDTWYATGILSFDK

SEQ ID NO: 69086 - protein, 7 aa, Homo sapiens
DYAEVGR

SEQ ID NO: 69087 - protein, 21 aa, Homo sapiens
FAVHDLEEDTWYATGILSFDK

SEQ ID NO: 69088 - protein, 6 aa, Homo sapiens
FTDHLK

SEQ ID NO: 69089 - protein, 20 aa, Homo sapiens
FTDHLKYVMLPVADQDQCIR

SEQ ID NO: 69090 - protein, 31 aa, Homo sapiens
FTDHLKYVMLPVADQDQCIRHYEGSTVPEKK

SEQ ID NO: 69091 - protein, 28 aa, Homo sapiens
GNDVTDIADDGCPKPPEIAHGYVEHSVR

SEQ ID NO: 69092 - protein, 17 aa, Homo sapiens
GVQPILNEHTFCAGMSK

SEQ ID NO: 69093 - protein, 8 aa, Homo sapiens
GYVEHSVR

SEQ ID NO: 69094 - protein, 9 aa, Homo sapiens
HGYVEHSVR

SEQ ID NO: 69095 - protein, 13 aa, Homo sapiens
HPNYSQVDIGLIK

SEQ ID NO: 69096 - protein, 10 aa, Homo sapiens
HYEGSTVPEK

SEQ ID NO: 69097 - protein, 11 aa, Homo sapiens
HYEGSTVPEKK

SEQ ID NO: 69098 - protein, 14 aa, Homo sapiens
HYEGSTVPEKKTPK

SEQ ID NO: 69099 - protein, 22 aa, Homo sapiens
IADDGCPKPPEIAHGYVEHSVR

SEQ ID NO: 69100 - protein, 7 aa, Homo sapiens
IQDWVQK

SEQ ID NO: 69101 - protein, 21 aa, Homo sapiens
KFTDHLKYVMLPVADQDQCIR

SEQ ID NO: 69102 - protein, 26 aa, Homo sapiens
KMVSHHNLTTGATLINEQWLLTTAKN

SEQ ID NO: 69103 - protein, 15 aa, Homo sapiens
KNLFLNHSENATAKD

SEQ ID NO: 69104 - protein, 24 aa, Homo sapiens
KQLVEIEKVVLHPNYSQVDIGLIK

SEQ ID NO: 69105 - protein, 24 aa, Homo sapiens
KTPKSPVGVQPILNEHTFCAGMSK

SEQ ID NO: 69106 - protein, 17 aa, Homo sapiens
KVVLHPNYSQVDIGLIK

SEQ ID NO: 69107 - protein, 18 aa, Homo sapiens
KVVLHPNYSQVDIGLIKL

SEQ ID NO: 69108 - protein, 16 aa, Homo sapiens
LEEDTWYATGILSFDK

SEQ ID NO: 69109 - protein, 14 aa, Homo sapiens
LHPNYSQVDIGLIK

SEQ ID NO: 69110 - protein, 10 aa, Homo sapiens
LKQKVSVNER

SEQ ID NO: 69111 - protein, 23 aa, Homo sapiens
LPECEADDGCPKPPEIAHGYVEH

SEQ ID NO: 69112 - protein, 26 aa, Homo sapiens
LPECEADDGCPKPPEIAHGYVEHSVR

SEQ ID NO: 69113 - protein, 11 aa, Homo sapiens
LPSKDYAEVGR

SEQ ID NO: 69114 - protein, 11 aa, Homo sapiens
LPVADQDQCIR

SEQ ID NO: 69115 - protein, 15 aa, Homo sapiens
LRTEGDGVYTLNNEK

SEQ ID NO: 69116 - protein, 20 aa, Homo sapiens
LRTEGDGVYTLNNEKQWINK

SEQ ID NO: 69117 - protein, 12 aa, Homo sapiens
MLPVADQDQCIR

SEQ ID NO: 69118 - protein, 11 aa, Homo sapiens
NANFKFTDHLK

SEQ ID NO: 69119 - protein, 19 aa, Homo sapiens
NYYKLRTEGDGVYTLNNEK

SEQ ID NO: 69120 - protein, 25 aa, Homo sapiens
PECEADDGCPKPPEIAHGYVEHSVR

SEQ ID NO: 69121 - protein, 13 aa, Homo sapiens
PEIAHGYVEHSVR

SEQ ID NO: 69122 - protein, 14 aa, Homo sapiens
PICLPSKDYAEVGR

SEQ ID NO: 69123 - protein, 23 aa, Homo sapiens
PICLPSKDYAEVGRVGYVSGWGR

SEQ ID NO: 69124 - protein, 14 aa, Homo sapiens
PILNEHTFCAGMSK

SEQ ID NO: 69125 - protein, 16 aa, Homo sapiens
PKPPEIAHGYVEHSVR

SEQ ID NO: 69126 - protein, 12 aa, Homo sapiens
PNYSQVDIGLIK

SEQ ID NO: 69127 - protein, 14 aa, Homo sapiens
PPEIAHGYVEHSVR

SEQ ID NO: 69128 - protein, 10 aa, Homo sapiens
PSKDYAEVGR

SEQ ID NO: 69129 - protein, 19 aa, Homo sapiens
PSKDYAEVGRVGYVSGWGR

SEQ ID NO: 69130 - protein, 10 aa, Homo sapiens
PVADQDQCIR

SEQ ID NO: 69131 - protein, 8 aa, Homo sapiens
QKVSVNER

SEQ ID NO: 69132 - protein, 23 aa, Homo sapiens
QLVEIEKVVLHPNYSQVDIGLIK

SEQ ID NO: 69133 - protein, 23 aa, Homo sapiens
SAFAVHDLEEDTWYATGILSFDK

SEQ ID NO: 69134 - protein, 29 aa, Homo sapiens
SGNDVTDIADDGCPKPPEIAHGYVEHSVR

SEQ ID NO: 69135 - protein, 8 aa, Homo sapiens
SIQDWVQK

SEQ ID NO: 69136 - protein, 16 aa, Homo sapiens
SPVGVQPILNEHTFCA

SEQ ID NO: 69137 - protein, 17 aa, Homo sapiens
SPVGVQPILNEHTFCAG

SEQ ID NO: 69138 - protein, 18 aa, Homo sapiens
SPVGVQPILNEHTFCAGM

SEQ ID NO: 69139 - protein, 19 aa, Homo sapiens
SPVGVQPILNEHTFCAGMS

SEQ ID NO: 69140 - protein, 20 aa, Homo sapiens
SPVGVQPILNEHTFCAGMSK

SEQ ID NO: 69141 - protein, 30 aa, Homo sapiens
TCYGDAGSAFAVHDLEEDTWYATGILSFDK

SEQ ID NO: 69142 - protein, 24 aa, Homo sapiens
TDIADDGCPKPPEIAHGYVEHSVR

SEQ ID NO: 69143 - protein, 12 aa, Homo sapiens
TEGDGVYTLNNE

SEQ ID NO: 69144 - protein, 13 aa, Homo sapiens
TEGDGVYTLNNEK

SEQ ID NO: 69145 - protein, 18 aa, Homo sapiens
TEGDGVYTLNNEKQWINK

SEQ ID NO: 69146 - protein, 8 aa, Homo sapiens
TGILSFDK

SEQ ID NO: 69147 - protein, 23 aa, Homo sapiens
TPKSPVGVQPILNEHTFCAGMSK

SEQ ID NO: 69148 - protein, 9 aa, Homo sapiens
TSIQDWVQK

SEQ ID NO: 69149 - protein, 12 aa, Homo sapiens
TWYATGILSFDK

SEQ ID NO: 69150 - protein, 31 aa, Homo sapiens
VDSGNDVTDIADDGCPKPPEIAHGYVEHSVR

SEQ ID NO: 69151 - protein, 35 aa, Homo sapiens
VDSGNDVTDIADDGCPKPPEIAHGYVEHSVRYQCK

SEQ ID NO: 69152 - protein, 18 aa, Homo sapiens
VGVQPILNEHTFCAGMSK

SEQ ID NO: 69153 - protein, 9 aa, Homo sapiens
VGYVSGWGR

SEQ ID NO: 69154 - protein, 14 aa, Homo sapiens
VGYVSGWGRNANFK

SEQ ID NO: 69155 - protein, 15 aa, Homo sapiens
VLHPNYSQVDIGLIK

SEQ ID NO: 69156 - protein, 10 aa, Homo sapiens
VMPICLPSKD

SEQ ID NO: 69157 - protein, 16 aa, Homo sapiens
VMPICLPSKDYAEVGR

SEQ ID NO: 69158 - protein, 22 aa, Homo sapiens
VMPICLPSKDYAEVGRVGYVSG

SEQ ID NO: 69159 - protein, 25 aa, Homo sapiens
VMPICLPSKDYAEVGRVGYVSGWGR

SEQ ID NO: 69160 - protein, 16 aa, Homo sapiens
VQPILNEHTFCAGMSK

SEQ ID NO: 69161 - protein, 6 aa, Homo sapiens
VSVNER

SEQ ID NO: 69162 - protein, 22 aa, Homo sapiens
VSVNERVMPICLPSKDYAEVGR

SEQ ID NO: 69163 - protein, 31 aa, Homo sapiens
VSVNERVMPICLPSKDYAEVGRVGYVSGWGR

SEQ ID NO: 69164 - protein, 10 aa, Homo sapiens
VTSIQDWVQK

SEQ ID NO: 69165 - protein, 15 aa, Homo sapiens
VTSIQDWVQKTIAEN

SEQ ID NO: 69166 - protein, 11 aa, Homo sapiens
VVLHPNYSQVD

SEQ ID NO: 69167 - protein, 15 aa, Homo sapiens
VVLHPNYSQVDIGLI

SEQ ID NO: 69168 - protein, 16 aa, Homo sapiens
VVLHPNYSQVDIGLIK

SEQ ID NO: 69169 - protein, 17 aa, Homo sapiens
VVLHPNYSQVDIGLIKL

SEQ ID NO: 69170 - protein, 18 aa, Homo sapiens
VVLHPNYSQVDIGLIKLK

SEQ ID NO: 69171 - protein, 20 aa, Homo sapiens
VVLHPNYSQVDIGLIKLKQK

SEQ ID NO: 69172 - protein, 10 aa, Homo sapiens
YEGSTVPEKK

SEQ ID NO: 69173 - protein, 8 aa, Homo sapiens
YQCKNYYK

SEQ ID NO: 69174 - protein, 10 aa, Homo sapiens
YQCKNYYKLR

SEQ ID NO: 69175 - protein, 34 aa, Homo sapiens
YQEDTCYGDAGSAFAVHDLEEDTWYATGILSFDK

SEQ ID NO: 69176 - protein, 10 aa, Homo sapiens
YSQVDIGLIK

SEQ ID NO: 69177 - protein, 7 aa, Homo sapiens
YVEHSVR

SEQ ID NO: 69178 - protein, 14 aa, Homo sapiens
YVMLPVADQDQCIR

SEQ ID NO: 69179 - protein, 24 aa, Homo sapiens
YVMLPVADQDQCIRHYEGSTVPEK

SEQ ID NO: 69180 - protein, 25 aa, Homo sapiens
YVMLPVADQDQCIRHYEGSTVPEKK

SEQ ID NO: 69181 - protein, 28 aa, Homo sapiens
YVMLPVADQDQCIRHYEGSTVPEKKTPK

SEQ ID NO: 69182 - protein, 30 aa, Homo sapiens
KYERGLIFYINHSLYENLDEELNEELAAKV

SEQ ID NO: 69183 - protein, 10 aa, Homo sapiens
AAFICPGSSR

SEQ ID NO: 69184 - protein, 23 aa, Homo sapiens
AAFSWEEKLYLVQGTQVYVFLTK

SEQ ID NO: 69185 - protein, 14 aa, Homo sapiens
AEGETKPDPDVTER

SEQ ID NO: 69186 - protein, 9 aa, Homo sapiens
AFSGTHYWR

SEQ ID NO: 69187 - protein, 19 aa, Homo sapiens
AHGNVAEGETKPDPDVTER

SEQ ID NO: 69188 - protein, 16 aa, Homo sapiens
ALPQPQNVTSLLGCTH

SEQ ID NO: 69189 - protein, 20 aa, Homo sapiens
ALTSDNHGATYAFSGTHYWR

SEQ ID NO: 69190 - protein, 14 aa, Homo sapiens
AQATWTELPWPHEK

SEQ ID NO: 69191 - protein, 12 aa, Homo sapiens
ATWTELPWPHEK

SEQ ID NO: 69192 - protein, 11 aa, Homo sapiens
AVDAAFSWEEK

SEQ ID NO: 69193 - protein, 9 aa, Homo sapiens
CFQGNQFLR

SEQ ID NO: 69194 - protein, 22 aa, Homo sapiens
CSDGWSFDATTLDDNGTMLFFK

SEQ ID NO: 69195 - protein, 17 aa, Homo sapiens
CSPHLVLSALTSDNHGA

SEQ ID NO: 69196 - protein, 19 aa, Homo sapiens
CSPHLVLSALTSDNHGATY

SEQ ID NO: 69197 - protein, 21 aa, Homo sapiens
CSPHLVLSALTSDNHGATYAF

SEQ ID NO: 69198 - protein, 23 aa, Homo sapiens
CSPHLVLSALTSDNHGATYAFSG

SEQ ID NO: 69199 - protein, 26 aa, Homo sapiens
CSPHLVLSALTSDNHGATYAFSGTHY

SEQ ID NO: 69200 - protein, 28 aa, Homo sapiens
CSPHLVLSALTSDNHGATYAFSGTHYWR

SEQ ID NO: 69201 - protein, 10 aa, Homo sapiens
DGWHSWPIAH

SEQ ID NO: 69202 - protein, 17 aa, Homo sapiens
DGWHSWPIAHQWPQGPS

SEQ ID NO: 69203 - protein, 21 aa, Homo sapiens
DGWHSWPIAHQWPQGPSAVDA

SEQ ID NO: 69204 - protein, 22 aa, Homo sapiens
DGWHSWPIAHQWPQGPSAVDAA

SEQ ID NO: 69205 - protein, 23 aa, Homo sapiens
DGWHSWPIAHQWPQGPSAVDAAF

SEQ ID NO: 69206 - protein, 28 aa, Homo sapiens
DGWHSWPIAHQWPQGPSAVDAAFSWEEK

SEQ ID NO: 69207 - protein, 43 aa, Homo sapiens
DGWHSWPIAHQWPQGPSAVDAAFSWEEKLYLVQGTQVYVFLTK

SEQ ID NO: 69208 - protein, 16 aa, Homo sapiens
DNHGATYAFSGTHYWR

SEQ ID NO: 69209 - protein, 12 aa, Homo sapiens
DVRDYFMPCPGR

SEQ ID NO: 69210 - protein, 9 aa, Homo sapiens
DYFMPCPGR

SEQ ID NO: 69211 - protein, 14 aa, Homo sapiens
DYFMPCPGRGHGHR

SEQ ID NO: 69212 - protein, 13 aa, Homo sapiens
EGETKPDPDVTER

SEQ ID NO: 69213 - protein, 6 aa, Homo sapiens
ELISER

SEQ ID NO: 69214 - protein, 15 aa, Homo sapiens
ERSWPAVGNCSSALR

SEQ ID NO: 69215 - protein, 33 aa, Homo sapiens
ETKPDPDVTERCSDGWSFDATTLDDNGTMLFFK

SEQ ID NO: 69216 - protein, 14 aa, Homo sapiens
EVGTPHGIILDSVD

SEQ ID NO: 69217 - protein, 16 aa, Homo sapiens
EVGTPHGIILDSVDAA

SEQ ID NO: 69218 - protein, 17 aa, Homo sapiens
EVGTPHGIILDSVDAAF

SEQ ID NO: 69219 - protein, 21 aa, Homo sapiens
EVGTPHGIILDSVDAAFICPG

SEQ ID NO: 69220 - protein, 22 aa, Homo sapiens
EVGTPHGIILDSVDAAFICPGS

SEQ ID NO: 69221 - protein, 24 aa, Homo sapiens
EVGTPHGIILDSVDAAFICPGSSR

SEQ ID NO: 69222 - protein, 11 aa, Homo sapiens
EWFWDLATGTM

SEQ ID NO: 69223 - protein, 12 aa, Homo sapiens
EWFWDLATGTMK

SEQ ID NO: 69224 - protein, 14 aa, Homo sapiens
EWFWDLATGTMKER

SEQ ID NO: 69225 - protein, 11 aa, Homo sapiens
FDPVRGEVPPR

SEQ ID NO: 69226 - protein, 10 aa, Homo sapiens
FPSPVDAAFR

SEQ ID NO: 69227 - protein, 17 aa, Homo sapiens
FQGDREWFWDLATGTMK

SEQ ID NO: 69228 - protein, 8 aa, Homo sapiens
FQGNQFLR

SEQ ID NO: 69229 - protein, 8 aa, Homo sapiens
FSGTHYWR

SEQ ID NO: 69230 - protein, 13 aa, Homo sapiens
GATYAFSGTHYWR

SEQ ID NO: 69231 - protein, 11 aa, Homo sapiens
GDKVWVYPPEK

SEQ ID NO: 69232 - protein, 12 aa, Homo sapiens
GDKVWVYPPEKK

SEQ ID NO: 69233 - protein, 14 aa, Homo sapiens
GDKVWVYPPEKKEK

SEQ ID NO: 69234 - protein, 10 aa, Homo sapiens
GECQAEGVLF

SEQ ID NO: 69235 - protein, 15 aa, Homo sapiens
GECQAEGVLFFQGDR

SEQ ID NO: 69236 - protein, 27 aa, Homo sapiens
GECQAEGVLFFQGDREWFWDLATGTMK

SEQ ID NO: 69237 - protein, 6 aa, Homo sapiens
GEFVWK

SEQ ID NO: 69238 - protein, 9 aa, Homo sapiens
GEFVWKSHK

SEQ ID NO: 69239 - protein, 12 aa, Homo sapiens
GEFVWKSHKWDR

SEQ ID NO: 69240 - protein, 18 aa, Homo sapiens
GEFVWKSHKWDRELISER

SEQ ID NO: 69241 - protein, 9 aa, Homo sapiens
GEVPPRYPR

SEQ ID NO: 69242 - protein, 11 aa, Homo sapiens
GGYTLVSGYPK

SEQ ID NO: 69243 - protein, 18 aa, Homo sapiens
GIILDSVDAAFICPGSSR

SEQ ID NO: 69244 - protein, 14 aa, Homo sapiens
GIPSPLDAAVECHR

SEQ ID NO: 69245 - protein, 23 aa, Homo sapiens
GLYLIHGPNLYCYSDVEKLNAAK

SEQ ID NO: 69246 - protein, 17 aa, Homo sapiens
GNVAEGETKPDPDVTER

SEQ ID NO: 69247 - protein, 20 aa, Homo sapiens
GPGLYLIHGPNLYCYSDVEK

SEQ ID NO: 69248 - protein, 25 aa, Homo sapiens
GPGLYLIHGPNLYCYSDVEKLNAAK

SEQ ID NO: 69249 - protein, 12 aa, Homo sapiens
GPNLYCYSDVEK

SEQ ID NO: 69250 - protein, 17 aa, Homo sapiens
GPNLYCYSDVEKLNAAK

SEQ ID NO: 69251 - protein, 28 aa, Homo sapiens
GPNSCSANGPGLYLIHGPNLYCYSDVEK

SEQ ID NO: 69252 - protein, 14 aa, Homo sapiens
GPSAVDAAFSWEEK

SEQ ID NO: 69253 - protein, 13 aa, Homo sapiens
GRYYCFQGNQFLR

SEQ ID NO: 69254 - protein, 16 aa, Homo sapiens
GTGHGNSTHHGPEYMR

SEQ ID NO: 69255 - protein, 19 aa, Homo sapiens
GTMKERSWPAVGNCSSALR

SEQ ID NO: 69256 - protein, 10 aa, Homo sapiens
GTQVYVFLTK

SEQ ID NO: 69257 - protein, 9 aa, Homo sapiens
GVLFFQGDR

SEQ ID NO: 69258 - protein, 14 aa, Homo sapiens
HGATYAFSGTHYWR

SEQ ID NO: 69259 - protein, 18 aa, Homo sapiens
HGNVAEGETKPDPDVTER

SEQ ID NO: 69260 - protein, 25 aa, Homo sapiens
HLVLSALTSDNHGATYAFSGTHYWR

SEQ ID NO: 69261 - protein, 8 aa, Homo sapiens
HNSVFLIK

SEQ ID NO: 69262 - protein, 14 aa, Homo sapiens
IKGDKVWVYPPEKK

SEQ ID NO: 69263 - protein, 17 aa, Homo sapiens
KALPQPQNVTSLLGCTH

SEQ ID NO: 69264 - protein, 22 aa, Homo sapiens
KLLQDEFPGIPSPLDAAVECHR

SEQ ID NO: 69265 - protein, 12 aa, Homo sapiens
KNFPSPVDAAFR

SEQ ID NO: 69266 - protein, 14 aa, Homo sapiens
LGRYYCFQGNQFLR

SEQ ID NO: 69267 - protein, 7 aa, Homo sapiens
LHIMAGR

SEQ ID NO: 69268 - protein, 8 aa, Homo sapiens
LHIMAGRR

SEQ ID NO: 69269 - protein, 15 aa, Homo sapiens
LIHGPNLYCYSDVEK

SEQ ID NO: 69270 - protein, 13 aa, Homo sapiens
LLQDEFPGIPSPL

SEQ ID NO: 69271 - protein, 14 aa, Homo sapiens
LLQDEFPGIPSPLD

SEQ ID NO: 69272 - protein, 16 aa, Homo sapiens
LLQDEFPGIPSPLDAA

SEQ ID NO: 69273 - protein, 19 aa, Homo sapiens
LLQDEFPGIPSPLDAAVEC

SEQ ID NO: 69274 - protein, 20 aa, Homo sapiens
LLQDEFPGIPSPLDAAVECH

SEQ ID NO: 69275 - protein, 21 aa, Homo sapiens
LLQDEFPGIPSPLDAAVECHR

SEQ ID NO: 69276 - protein, 22 aa, Homo sapiens
LLQDEFPGIPSPLDAAVECHRG

SEQ ID NO: 69277 - protein, 36 aa, Homo sapiens
LLQDEFPGIPSPLDAAVECHRGECQAEGVLFFQGDR

SEQ ID NO: 69278 - protein, 21 aa, Homo sapiens
LNAAKALPQPQNVTSLLGCTH

SEQ ID NO: 69279 - protein, 24 aa, Homo sapiens
LPPTSAHGNVAEGETKPDPDVTER

SEQ ID NO: 69280 - protein, 19 aa, Homo sapiens
LTSDNHGATYAFSGTHYWR

SEQ ID NO: 69281 - protein, 24 aa, Homo sapiens
LVLSALTSDNHGATYAFSGTHYWR

SEQ ID NO: 69282 - protein, 13 aa, Homo sapiens
LVQGTQVYVFLTK

SEQ ID NO: 69283 - protein, 7 aa, Homo sapiens
LWWLDLK

SEQ ID NO: 69284 - protein, 9 aa, Homo sapiens
LYCYSDVEK

SEQ ID NO: 69285 - protein, 17 aa, Homo sapiens
LYLIHGPNLYCYSDVEK

SEQ ID NO: 69286 - protein, 10 aa, Homo sapiens
LYLVQGTQVY

SEQ ID NO: 69287 - protein, 12 aa, Homo sapiens
LYLVQGTQVYVF

SEQ ID NO: 69288 - protein, 15 aa, Homo sapiens
LYLVQGTQVYVFLTK

SEQ ID NO: 69289 - protein, 26 aa, Homo sapiens
LYLVQGTQVYVFLTKGGYTLVSGYPK

SEQ ID NO: 69290 - protein, 20 aa, Homo sapiens
NAAKALPQPQNVTSLLGCTH

SEQ ID NO: 69291 - protein, 11 aa, Homo sapiens
NFPSPVDAAFR

SEQ ID NO: 69292 - protein, 15 aa, Homo sapiens
NFPSPVDAAFRQGHN

SEQ ID NO: 69293 - protein, 21 aa, Homo sapiens
NFPSPVDAAFRQGHNSVFLIK

SEQ ID NO: 69294 - protein, 21 aa, Homo sapiens
NGPGLYLIHGPNLYCYSDVEK

SEQ ID NO: 69295 - protein, 15 aa, Homo sapiens
NHGATYAFSGTHYWR

SEQ ID NO: 69296 - protein, 26 aa, Homo sapiens
NSCSANGPGLYLIHGPNLYCYSDVEK

SEQ ID NO: 69297 - protein, 16 aa, Homo sapiens
NVAEGETKPDPDVTER

SEQ ID NO: 69298 - protein, 10 aa, Homo sapiens
NVTSLLGCTH

SEQ ID NO: 69299 - protein, 11 aa, Homo sapiens
PAVGNCSSALR

SEQ ID NO: 69300 - protein, 15 aa, Homo sapiens
PGIPSPLDAAVECHR

SEQ ID NO: 69301 - protein, 19 aa, Homo sapiens
PGLYLIHGPNLYCYSDVEK

SEQ ID NO: 69302 - protein, 13 aa, Homo sapiens
PHEKVDGALCMEK

SEQ ID NO: 69303 - protein, 22 aa, Homo sapiens
PIAHQWPQGPSAVDAAFSWEEK

SEQ ID NO: 69304 - protein, 11 aa, Homo sapiens
PNLYCYSDVEK

SEQ ID NO: 69305 - protein, 16 aa, Homo sapiens
PNLYCYSDVEKLNAAK

SEQ ID NO: 69306 - protein, 27 aa, Homo sapiens
PNSCSANGPGLYLIHGPNLYCYSDVEK

SEQ ID NO: 69307 - protein, 23 aa, Homo sapiens
PPTSAHGNVAEGETKPDPDVTER

SEQ ID NO: 69308 - protein, 16 aa, Homo sapiens
PQGPSAVDAAFSWEEK

SEQ ID NO: 69309 - protein, 12 aa, Homo sapiens
PQNVTSLLGCTH

SEQ ID NO: 69310 - protein, 14 aa, Homo sapiens
PQPQNVTSLLGCTH

SEQ ID NO: 69311 - protein, 12 aa, Homo sapiens
PSPLDAAVECHR

SEQ ID NO: 69312 - protein, 9 aa, Homo sapiens
PSPVDAAFR

SEQ ID NO: 69313 - protein, 22 aa, Homo sapiens
PTSAHGNVAEGETKPDPDVTER

SEQ ID NO: 69314 - protein, 12 aa, Homo sapiens
QAEGVLFFQGDR

SEQ ID NO: 69315 - protein, 13 aa, Homo sapiens
QATWTELPWPHEK

SEQ ID NO: 69316 - protein, 10 aa, Homo sapiens
QGHNSVFLIK

SEQ ID NO: 69317 - protein, 13 aa, Homo sapiens
QGHNSVFLIKGDK

SEQ ID NO: 69318 - protein, 22 aa, Homo sapiens
QGHNSVFLIKGDKVWVYPPEKK

SEQ ID NO: 69319 - protein, 24 aa, Homo sapiens
QGHNSVFLIKGDKVWVYPPEKKEK

SEQ ID NO: 69320 - protein, 18 aa, Homo sapiens
QWPQGPSAVDAAFSWEEK

SEQ ID NO: 69321 - protein, 24 aa, Homo sapiens
RCSDGWSFDATTLDDNGTMLFFKG

SEQ ID NO: 69322 - protein, 28 aa, Homo sapiens
RLEKEVGTPHGIILDSVDAAFICPGSSR

SEQ ID NO: 69323 - protein, 8 aa, Homo sapiens
RLWWLDLK

SEQ ID NO: 69324 - protein, 24 aa, Homo sapiens
RLWWLDLKSGAQATWTELPWPHEK

SEQ ID NO: 69325 - protein, 33 aa, Homo sapiens
RLWWLDLKSGAQATWTELPWPHEKVDGALCMEK

SEQ ID NO: 69326 - protein, 19 aa, Homo sapiens
RNGTGHGNSTHHGPEYMRC

SEQ ID NO: 69327 - protein, 15 aa, Homo sapiens
RSWPAVGNCSSALRW

SEQ ID NO: 69328 - protein, 20 aa, Homo sapiens
SAHGNVAEGETKPDPDVTER

SEQ ID NO: 69329 - protein, 14 aa, Homo sapiens
SALTSDNHGATYAF

SEQ ID NO: 69330 - protein, 21 aa, Homo sapiens
SALTSDNHGATYAFSGTHYWR

SEQ ID NO: 69331 - protein, 23 aa, Homo sapiens
SANGPGLYLIHGPNLYCYSDVEK

SEQ ID NO: 69332 - protein, 25 aa, Homo sapiens
SCSANGPGLYLIHGPNLYCYSDVEK

SEQ ID NO: 69333 - protein, 21 aa, Homo sapiens
SDGWSFDATTLDDNGTMLFFK

SEQ ID NO: 69334 - protein, 17 aa, Homo sapiens
SDNHGATYAFSGTHYWR

SEQ ID NO: 69335 - protein, 17 aa, Homo sapiens
SFDATTLDDNGTMLFFK

SEQ ID NO: 69336 - protein, 14 aa, Homo sapiens
SGAQATWTELPWPH

SEQ ID NO: 69337 - protein, 16 aa, Homo sapiens
SGAQATWTELPWPHEK

SEQ ID NO: 69338 - protein, 25 aa, Homo sapiens
SGAQATWTELPWPHEKVDGALCMEK

SEQ ID NO: 69339 - protein, 7 aa, Homo sapiens
SGTHYWR

SEQ ID NO: 69340 - protein, 6 aa, Homo sapiens
SHKWDR

SEQ ID NO: 69341 - protein, 12 aa, Homo sapiens
SHKWDRELISER

SEQ ID NO: 69342 - protein, 15 aa, Homo sapiens
SLGPNSCSANGPGLY

SEQ ID NO: 69343 - protein, 18 aa, Homo sapiens
SLGPNSCSANGPGLYLIH

SEQ ID NO: 69344 - protein, 19 aa, Homo sapiens
SLGPNSCSANGPGLYLIHG

SEQ ID NO: 69345 - protein, 21 aa, Homo sapiens
SLGPNSCSANGPGLYLIHGPN

SEQ ID NO: 69346 - protein, 23 aa, Homo sapiens
SLGPNSCSANGPGLYLIHGPNLY

SEQ ID NO: 69347 - protein, 27 aa, Homo sapiens
SLGPNSCSANGPGLYLIHGPNLYCYSD

SEQ ID NO: 69348 - protein, 30 aa, Homo sapiens
SLGPNSCSANGPGLYLIHGPNLYCYSDVEK

SEQ ID NO: 69349 - protein, 35 aa, Homo sapiens
SLGPNSCSANGPGLYLIHGPNLYCYSDVEKLNAAK

SEQ ID NO: 69350 - protein, 27 aa, Homo sapiens
SPHLVLSALTSDNHGATYAFSGTHYWR

SEQ ID NO: 69351 - protein, 10 aa, Homo sapiens
STHHGPEYMR

SEQ ID NO: 69352 - protein, 13 aa, Homo sapiens
SVDAAFICPGSSR

SEQ ID NO: 69353 - protein, 18 aa, Homo sapiens
SVFLIKGDKVWVYPPEKK

SEQ ID NO: 69354 - protein, 20 aa, Homo sapiens
SVFLIKGDKVWVYPPEKKEK

SEQ ID NO: 69355 - protein, 13 aa, Homo sapiens
SWPAVGNCSSALR

SEQ ID NO: 69356 - protein, 24 aa, Homo sapiens
SWPIAHQWPQGPSAVDAAFSWEEK

SEQ ID NO: 69357 - protein, 8 aa, Homo sapiens
TLVSGYPK

SEQ ID NO: 69358 - protein, 21 aa, Homo sapiens
TPHGIILDSVDAAFICPGSSR

SEQ ID NO: 69359 - protein, 20 aa, Homo sapiens
TPLPPTSAHGNVAEGETKPD

SEQ ID NO: 69360 - protein, 26 aa, Homo sapiens
TPLPPTSAHGNVAEGETKPDPDVTER

SEQ ID NO: 69361 - protein, 21 aa, Homo sapiens
TSAHGNVAEGETKPDPDVTER

SEQ ID NO: 69362 - protein, 18 aa, Homo sapiens
TSDNHGATYAFSGTHYWR

SEQ ID NO: 69363 - protein, 11 aa, Homo sapiens
TWTELPWPHEK

SEQ ID NO: 69364 - protein, 11 aa, Homo sapiens
TYAFSGTHYWR

SEQ ID NO: 69365 - protein, 15 aa, Homo sapiens
VAEGETKPDPDVTER

SEQ ID NO: 69366 - protein, 9 aa, Homo sapiens
VDGALCMEK

SEQ ID NO: 69367 - protein, 9 aa, Homo sapiens
VTSLLGCTH

SEQ ID NO: 69368 - protein, 8 aa, Homo sapiens
VWVYPPEK

SEQ ID NO: 69369 - protein, 9 aa, Homo sapiens
VWVYPPEKK

SEQ ID NO: 69370 - protein, 9 aa, Homo sapiens
WDRELISER

SEQ ID NO: 69371 - protein, 13 aa, Homo sapiens
WKNFPSPVDAAFR

SEQ ID NO: 69372 - protein, 23 aa, Homo sapiens
WKNFPSPVDAAFRQGHNSVFLIK

SEQ ID NO: 69373 - protein, 35 aa, Homo sapiens
WKNFPSPVDAAFRQGHNSVFLIKGDKVWVYPPEKK

SEQ ID NO: 69374 - protein, 15 aa, Homo sapiens
WLGRYYCFQGNQFLR

SEQ ID NO: 69375 - protein, 12 aa, Homo sapiens
WPAVGNCSSALR

SEQ ID NO: 69376 - protein, 10 aa, Homo sapiens
WTELPWPHEK

SEQ ID NO: 69377 - protein, 10 aa, Homo sapiens
YAFSGTHYWR

SEQ ID NO: 69378 - protein, 10 aa, Homo sapiens
YCFQGNQFLR

SEQ ID NO: 69379 - protein, 14 aa, Homo sapiens
YLVQGTQVYVFLTK

SEQ ID NO: 69380 - protein, 9 aa, Homo sapiens
YYCFQGNQF

SEQ ID NO: 69381 - protein, 11 aa, Homo sapiens
YYCFQGNQFLR

SEQ ID NO: 69382 - protein, 10 aa, Homo sapiens
AAYQVAALPK

SEQ ID NO: 69383 - protein, 16 aa, Homo sapiens
APGAIGPYSQAVLVDR

SEQ ID NO: 69384 - protein, 14 aa, Homo sapiens
GAIGPYSQAVLVDR

SEQ ID NO: 69385 - protein, 19 aa, Homo sapiens
TTVLLADINDFNTVNEIYK

SEQ ID NO: 69386 - protein, 12 aa, Homo sapiens
AAISGENAGLVR

SEQ ID NO: 69387 - protein, 26 aa, Homo sapiens
ADQDGLKPTIDKPSEDSPPLEMLGPR

SEQ ID NO: 69388 - protein, 12 aa, Homo sapiens
ADVQAHGEGQEF

SEQ ID NO: 69389 - protein, 15 aa, Homo sapiens
ADVQAHGEGQEFSIT

SEQ ID NO: 69390 - protein, 24 aa, Homo sapiens
ADVQAHGEGQEFSITCLVDEEEMK

SEQ ID NO: 69391 - protein, 25 aa, Homo sapiens
ADVQAHGEGQEFSITCLVDEEEMKK

SEQ ID NO: 69392 - protein, 9 aa, Homo sapiens
ANLSSQALR

SEQ ID NO: 69393 - protein, 19 aa, Homo sapiens
ANNHFAHFFAPQNLTNMNK

SEQ ID NO: 69394 - protein, 14 aa, Homo sapiens
ASEANLQAAQDFVR

SEQ ID NO: 69395 - protein, 19 aa, Homo sapiens
ASILIMLTDGDPTEGVTDR

SEQ ID NO: 69396 - protein, 12 aa, Homo sapiens
AVDTAVDGVFIR

SEQ ID NO: 69397 - protein, 14 aa, Homo sapiens
AVTADGNAFIGDIK

SEQ ID NO: 69398 - protein, 24 aa, Homo sapiens
CDLLVANNHFAHFFAPQNLTNMNK

SEQ ID NO: 69399 - protein, 12 aa, Homo sapiens
DAVLALTQNHHK

SEQ ID NO: 69400 - protein, 27 aa, Homo sapiens
DEICDLLVANNHFAHFFAPQNLTNMNK

SEQ ID NO: 69401 - protein, 23 aa, Homo sapiens
DLLVANNHFAHFFAPQNLTNMNK

SEQ ID NO: 69402 - protein, 12 aa, Homo sapiens
EANLQAAQDFVR

SEQ ID NO: 69403 - protein, 8 aa, Homo sapiens
ELAAQTIK

SEQ ID NO: 69404 - protein, 9 aa, Homo sapiens
ELAAQTIKK

SEQ ID NO: 69405 - protein, 12 aa, Homo sapiens
ERGHMLENHVER

SEQ ID NO: 69406 - protein, 10 aa, Homo sapiens
EVAFDLEIPK

SEQ ID NO: 69407 - protein, 12 aa, Homo sapiens
FAHYVVTSQVVN

SEQ ID NO: 69408 - protein, 15 aa, Homo sapiens
FAHYVVTSQVVNTAN

SEQ ID NO: 69409 - protein, 18 aa, Homo sapiens
FAHYVVTSQVVNTANEAR

SEQ ID NO: 69410 - protein, 15 aa, Homo sapiens
FAVTADGNAFIGDIK

SEQ ID NO: 69411 - protein, 12 aa, Homo sapiens
FFAPQNLTNMNK

SEQ ID NO: 69412 - protein, 10 aa, Homo sapiens
FPLYNLGFGH

SEQ ID NO: 69413 - protein, 12 aa, Homo sapiens
FPLYNLGFGHNV

SEQ ID NO: 69414 - protein, 15 aa, Homo sapiens
FPLYNLGFGHNVDFN

SEQ ID NO: 69415 - protein, 20 aa, Homo sapiens
FPLYNLGFGHNVDFNFLEVM

SEQ ID NO: 69416 - protein, 27 aa, Homo sapiens
FPLYNLGFGHNVDFNFLEVMSMENNGR

SEQ ID NO: 69417 - protein, 18 aa, Homo sapiens
GEGQEFSITCLVDEEEMK

SEQ ID NO: 69418 - protein, 16 aa, Homo sapiens
GFSLDEATNLNGGLLR

SEQ ID NO: 69419 - protein, 10 aa, Homo sapiens
GHMLENHVER

SEQ ID NO: 69420 - protein, 28 aa, Homo sapiens
GHVLFRPTVSQQQSCPTCSTSLLNGHFK

SEQ ID NO: 69421 - protein, 17 aa, Homo sapiens
GIEILNQVQESLPELSN

SEQ ID NO: 69422 - protein, 18 aa, Homo sapiens
GIEILNQVQESLPELSNH

SEQ ID NO: 69423 - protein, 19 aa, Homo sapiens
GIEILNQVQESLPELSNHA

SEQ ID NO: 69424 - protein, 20 aa, Homo sapiens
GIEILNQVQESLPELSNHAS

SEQ ID NO: 69425 - protein, 22 aa, Homo sapiens
GIEILNQVQESLPELSNHASIL

SEQ ID NO: 69426 - protein, 37 aa, Homo sapiens
GIEILNQVQESLPELSNHASILIMLTDGDPTEGVTDR

SEQ ID NO: 69427 - protein, 24 aa, Homo sapiens
GMADQDGLKPTIDKPSEDSPPLEM

SEQ ID NO: 69428 - protein, 28 aa, Homo sapiens
GMADQDGLKPTIDKPSEDSPPLEMLGPR

SEQ ID NO: 69429 - protein, 10 aa, Homo sapiens
GRFPLYNLGF

SEQ ID NO: 69430 - protein, 12 aa, Homo sapiens
GRFPLYNLGFGH

SEQ ID NO: 69431 - protein, 13 aa, Homo sapiens
GRFPLYNLGFGHN

SEQ ID NO: 69432 - protein, 29 aa, Homo sapiens
GRFPLYNLGFGHNVDFNFLEVMSMENNGR

SEQ ID NO: 69433 - protein, 19 aa, Homo sapiens
GSLVQASEANLQAAQDFVR

SEQ ID NO: 69434 - protein, 20 aa, Homo sapiens
GSLVQASEANLQAAQDFVRG

SEQ ID NO: 69435 - protein, 18 aa, Homo sapiens
GSSVHQDFLGFYVLDSHR

SEQ ID NO: 69436 - protein, 16 aa, Homo sapiens
HFAHFFAPQNLTNMNK

SEQ ID NO: 69437 - protein, 16 aa, Homo sapiens
HFEIDVDIFEPQGISK

SEQ ID NO: 69438 - protein, 10 aa, Homo sapiens
IADNKQSSFK

SEQ ID NO: 69439 - protein, 13 aa, Homo sapiens
ICDLLVANNHFAH

SEQ ID NO: 69440 - protein, 25 aa, Homo sapiens
ICDLLVANNHFAHFFAPQNLTNMNK

SEQ ID NO: 69441 - protein, 16 aa, Homo sapiens
ILGDMQPGDYFDLVLF

SEQ ID NO: 69442 - protein, 19 aa, Homo sapiens
ILGDMQPGDYFDLVLFGTR

SEQ ID NO: 69443 - protein, 17 aa, Homo sapiens
ILIMLTDGDPTEGVTDR

SEQ ID NO: 69444 - protein, 15 aa, Homo sapiens
IMLTDGDPTEGVTDR

SEQ ID NO: 69445 - protein, 18 aa, Homo sapiens
ISDFAVTADGNAFIGDIK

SEQ ID NO: 69446 - protein, 10 aa, Homo sapiens
ISGENAGLVR

SEQ ID NO: 69447 - protein, 14 aa, Homo sapiens
IYEDHDATQQLQGF

SEQ ID NO: 69448 - protein, 15 aa, Homo sapiens
IYEDHDATQQLQGFY

SEQ ID NO: 69449 - protein, 17 aa, Homo sapiens
IYEDHDATQQLQGFYSQ

SEQ ID NO: 69450 - protein, 20 aa, Homo sapiens
IYEDHDATQQLQGFYSQVAK

SEQ ID NO: 69451 - protein, 13 aa, Homo sapiens
KAAISGENAGLVR

SEQ ID NO: 69452 - protein, 7 aa, Homo sapiens
KGHVLFR

SEQ ID NO: 69453 - protein, 29 aa, Homo sapiens
KGHVLFRPTVSQQQSCPTCSTSLLNGHFK

SEQ ID NO: 69454 - protein, 10 aa, Homo sapiens
LDAQASFLPK

SEQ ID NO: 69455 - protein, 11 aa, Homo sapiens
LPDRVTGVDTD

SEQ ID NO: 69456 - protein, 9 aa, Homo sapiens
LQAAQDFVR

SEQ ID NO: 69457 - protein, 13 aa, Homo sapiens
LTDGDPTEGVTDR

SEQ ID NO: 69458 - protein, 9 aa, Homo sapiens
LTIQELLAK

SEQ ID NO: 69459 - protein, 22 aa, Homo sapiens
LVDVDLQYPQDAVLALTQNHHK

SEQ ID NO: 69460 - protein, 13 aa, Homo sapiens
LWAYLTIQELLAK

SEQ ID NO: 69461 - protein, 14 aa, Homo sapiens
LWAYLTIQELLAKR

SEQ ID NO: 69462 - protein, 8 aa, Homo sapiens
MLENHVER

SEQ ID NO: 69463 - protein, 17 aa, Homo sapiens
MSLDYGFVTPLTSMSIR

SEQ ID NO: 69464 - protein, 17 aa, Homo sapiens
NHFAHFFAPQNLTNMNK

SEQ ID NO: 69465 - protein, 10 aa, Homo sapiens
NHMQYEIVIK

SEQ ID NO: 69466 - protein, 18 aa, Homo sapiens
NNHFAHFFAPQNLTNMNK

SEQ ID NO: 69467 - protein, 17 aa, Homo sapiens
NVDFNFLEVMSMENNGR

SEQ ID NO: 69468 - protein, 13 aa, Homo sapiens
NVVFVIDISGSMR

SEQ ID NO: 69469 - protein, 13 aa, Homo sapiens
PGDYFDLVLFGTR

SEQ ID NO: 69470 - protein, 24 aa, Homo sapiens
PLLVDVDLQYPQDAVLALTQNHHK

SEQ ID NO: 69471 - protein, 14 aa, Homo sapiens
PQDAVLALTQNHHK

SEQ ID NO: 69472 - protein, 14 aa, Homo sapiens
PSEDSPPLEMLGPR

SEQ ID NO: 69473 - protein, 12 aa, Homo sapiens
PSPTHSSSNTQR

SEQ ID NO: 69474 - protein, 13 aa, Homo sapiens
PTEGVTDRSQILK

SEQ ID NO: 69475 - protein, 22 aa, Homo sapiens
PTVSQQQSCPTCSTSLLNGHFK

SEQ ID NO: 69476 - protein, 13 aa, Homo sapiens
QAVDTAVDGVFIR

SEQ ID NO: 69477 - protein, 20 aa, Homo sapiens
QLVHHFEIDVDIFEPQGISK

SEQ ID NO: 69478 - protein, 13 aa, Homo sapiens
QYYEGSEIVVAGR

SEQ ID NO: 69479 - protein, 11 aa, Homo sapiens
RNHMQYEIVIK

SEQ ID NO: 69480 - protein, 14 aa, Homo sapiens
RQAVDTAVDGVFIR

SEQ ID NO: 69481 - protein, 21 aa, Homo sapiens
RTFVLSALQPSPTHSSSNTQR

SEQ ID NO: 69482 - protein, 12 aa, Homo sapiens
SITCLVDEEEMK

SEQ ID NO: 69483 - protein, 14 aa, Homo sapiens
SLDEATNLNGGLLR

SEQ ID NO: 69484 - protein, 16 aa, Homo sapiens
SLDYGFVTPLTSMSIR

SEQ ID NO: 69485 - protein, 18 aa, Homo sapiens
SLVQASEANLQAAQDFVR

SEQ ID NO: 69486 - protein, 10 aa, Homo sapiens
SPPLEMLGPR

SEQ ID NO: 69487 - protein, 15 aa, Homo sapiens
SPTHSSSNTQRLPDR

SEQ ID NO: 69488 - protein, 11 aa, Homo sapiens
SQVVNTANEAR

SEQ ID NO: 69489 - protein, 16 aa, Homo sapiens
TAFISDFAVTADGNAF

SEQ ID NO: 69490 - protein, 21 aa, Homo sapiens
TAFISDFAVTADGNAFIGDIK

SEQ ID NO: 69491 - protein, 28 aa, Homo sapiens
TAFISDFAVTADGNAFIGDIKDKVTAWK

SEQ ID NO: 69492 - protein, 20 aa, Homo sapiens
TFVLSALQPSPTHSSSNTQR

SEQ ID NO: 69493 - protein, 11 aa, Homo sapiens
TIHLTVNPQSK

SEQ ID NO: 69494 - protein, 16 aa, Homo sapiens
TMEQFTIHLTVNPQSK

SEQ ID NO: 69495 - protein, 20 aa, Homo sapiens
VANNHFAHFFAPQNLTNMNK

SEQ ID NO: 69496 - protein, 9 aa, Homo sapiens
VIDISGSMR

SEQ ID NO: 69497 - protein, 26 aa, Homo sapiens
VLFRPTVSQQQSCPTCSTSLLNGHFK

SEQ ID NO: 69498 - protein, 24 aa, Homo sapiens
VQSWKGSLVQASEANLQAAQDFVR

SEQ ID NO: 69499 - protein, 12 aa, Homo sapiens
VTFQLTYEEVLK

SEQ ID NO: 69500 - protein, 13 aa, Homo sapiens
VTFQLTYEEVLKR

SEQ ID NO: 69501 - protein, 14 aa, Homo sapiens
VVTSQVVNTANEAR

SEQ ID NO: 69502 - protein, 10 aa, Homo sapiens
YLTIQELLAK

SEQ ID NO: 69503 - protein, 15 aa, Homo sapiens
YPQDAVLALTQNHHK

SEQ ID NO: 69504 - protein, 15 aa, Homo sapiens
YVVTSQVVNTANEAR

SEQ ID NO: 69505 - protein, 12 aa, Homo sapiens
YYEGSEIVVAGR

SEQ ID NO: 69506 - protein, 13 aa, Homo sapiens
AEDHFSVIDFNQN

SEQ ID NO: 69507 - protein, 15 aa, Homo sapiens
AEDHFSVIDFNQNIR

SEQ ID NO: 69508 - protein, 13 aa, Homo sapiens
AGELEVFNGYFVH

SEQ ID NO: 69509 - protein, 14 aa, Homo sapiens
AGELEVFNGYFVHF

SEQ ID NO: 69510 - protein, 15 aa, Homo sapiens
AGELEVFNGYFVHFF

SEQ ID NO: 69511 - protein, 21 aa, Homo sapiens
AGELEVFNGYFVHFFAPDNLD

SEQ ID NO: 69512 - protein, 25 aa, Homo sapiens
AGELEVFNGYFVHFFAPDNLDPIPK

SEQ ID NO: 69513 - protein, 11 aa, Homo sapiens
AHVSFKPTVAQ

SEQ ID NO: 69514 - protein, 13 aa, Homo sapiens
AHVSFKPTVAQQR

SEQ ID NO: 69515 - protein, 17 aa, Homo sapiens
AIFILNEANNLGLLDPN

SEQ ID NO: 69516 - protein, 7 aa, Homo sapiens
ALYAQAR

SEQ ID NO: 69517 - protein, 13 aa, Homo sapiens
AVDGELVVLYDVK

SEQ ID NO: 69518 - protein, 12 aa, Homo sapiens
AYLTINQLLAER

SEQ ID NO: 69519 - protein, 10 aa, Homo sapiens
DKHADPDFTR

SEQ ID NO: 69520 - protein, 25 aa, Homo sapiens
DKHADPDFTRKLWAYLTINQLLAER

SEQ ID NO: 69521 - protein, 21 aa, Homo sapiens
DVTQNNFHNYFGGSEIVVAGK

SEQ ID NO: 69522 - protein, 12 aa, Homo sapiens
EGHFDGVPVISK

SEQ ID NO: 69523 - protein, 10 aa, Homo sapiens
ENIQDNISLF

SEQ ID NO: 69524 - protein, 12 aa, Homo sapiens
ENIQDNISLFSL

SEQ ID NO: 69525 - protein, 24 aa, Homo sapiens
ENIQDNISLFSLGMGFDVDYDFLK

SEQ ID NO: 69526 - protein, 25 aa, Homo sapiens
ENIQDNISLFSLGMGFDVDYDFLKR

SEQ ID NO: 69527 - protein, 12 aa, Homo sapiens
ETAVDGELVVLY

SEQ ID NO: 69528 - protein, 15 aa, Homo sapiens
ETAVDGELVVLYDVK

SEQ ID NO: 69529 - protein, 11 aa, Homo sapiens
FAPDNLDPIPK

SEQ ID NO: 69530 - protein, 39 aa, Homo sapiens
FDPAKLDQIESVITATSANTQLVLETLAQMDDLQDFLSK

SEQ ID NO: 69531 - protein, 13 aa, Homo sapiens
FEGHFDGVPVISK

SEQ ID NO: 69532 - protein, 9 aa, Homo sapiens
FELHYQEVK

SEQ ID NO: 69533 - protein, 12 aa, Homo sapiens
FFAPDNLDPIPK

SEQ ID NO: 69534 - protein, 11 aa, Homo sapiens
FGGSEIVVAGK

SEQ ID NO: 69535 - protein, 15 aa, Homo sapiens
FHNYFGGSEIVVAGK

SEQ ID NO: 69536 - protein, 8 aa, Homo sapiens
FLHVPDTF

SEQ ID NO: 69537 - protein, 12 aa, Homo sapiens
FLHVPDTFEGHF

SEQ ID NO: 69538 - protein, 20 aa, Homo sapiens
FLHVPDTFEGHFDGVPVISK

SEQ ID NO: 69539 - protein, 24 aa, Homo sapiens
FLHVPDTFEGHFDGVPVISKGQQK

SEQ ID NO: 69540 - protein, 19 aa, Homo sapiens
FNGYFVHFFAPDNLDPIPK

SEQ ID NO: 69541 - protein, 30 aa, Homo sapiens
FNYPHTSVTDVTQNNFHNYFGGSEIVVAGK

SEQ ID NO: 69542 - protein, 8 aa, Homo sapiens
FQLVAENR

SEQ ID NO: 69543 - protein, 15 aa, Homo sapiens
FVHFFAPDNLDPIPK

SEQ ID NO: 69544 - protein, 11 aa, Homo sapiens
FYNQVSTPLLR

SEQ ID NO: 69545 - protein, 14 aa, Homo sapiens
GAFISNFSMTVDGK

SEQ ID NO: 69546 - protein, 17 aa, Homo sapiens
GAFISNFSMTVDGKTFR

SEQ ID NO: 69547 - protein, 10 aa, Homo sapiens
GELVVLYDVK

SEQ ID NO: 69548 - protein, 10 aa, Homo sapiens
GFDVDYDFLK

SEQ ID NO: 69549 - protein, 11 aa, Homo sapiens
GHFDGVPVISK

SEQ ID NO: 69550 - protein, 12 aa, Homo sapiens
GMGFDVDYDFLK

SEQ ID NO: 69551 - protein, 17 aa, Homo sapiens
GQQKAHVSFKPTVAQQR

SEQ ID NO: 69552 - protein, 17 aa, Homo sapiens
GYFVHFFAPDNLDPIPK

SEQ ID NO: 69553 - protein, 8 aa, Homo sapiens
HADPDFTR

SEQ ID NO: 69554 - protein, 10 aa, Homo sapiens
HFDGVPVISK

SEQ ID NO: 69555 - protein, 19 aa, Homo sapiens
HIVTPLTSLVIENEAGDER

SEQ ID NO: 69556 - protein, 12 aa, Homo sapiens
HLEVDVWVIEPQ

SEQ ID NO: 69557 - protein, 15 aa, Homo sapiens
HLEVDVWVIEPQGLR

SEQ ID NO: 69558 - protein, 14 aa, Homo sapiens
HNYFGGSEIVVAGK

SEQ ID NO: 69559 - protein, 15 aa, Homo sapiens
IILVSDGDPTVGELK

SEQ ID NO: 69560 - protein, 33 aa, Homo sapiens
ILNEANNLGLLDPNSVSLIILVSDGDPTVGELK

SEQ ID NO: 69561 - protein, 12 aa, Homo sapiens
IQPSGGTNINEA

SEQ ID NO: 69562 - protein, 15 aa, Homo sapiens
IQPSGGTNINEALLR

SEQ ID NO: 69563 - protein, 11 aa, Homo sapiens
ISNFSMTVDGK

SEQ ID NO: 69564 - protein, 18 aa, Homo sapiens
IVTPLTSLVIENEAGDER

SEQ ID NO: 69565 - protein, 12 aa, Homo sapiens
IYGNQDTSSQLK

SEQ ID NO: 69566 - protein, 13 aa, Homo sapiens
IYGNQDTSSQLKK

SEQ ID NO: 69567 - protein, 24 aa, Homo sapiens
IYGNQDTSSQLKKFYNQVSTPLLR

SEQ ID NO: 69568 - protein, 7 aa, Homo sapiens
IYLQPGR

SEQ ID NO: 69569 - protein, 26 aa, Homo sapiens
KENIQDNISLFSLGMGFDVDYDFLKR

SEQ ID NO: 69570 - protein, 27 aa, Homo sapiens
KENIQDNISLFSLGMGFDVDYDFLKRL

SEQ ID NO: 69571 - protein, 12 aa, Homo sapiens
KFYNQVSTPLLR

SEQ ID NO: 69572 - protein, 16 aa, Homo sapiens
KGAFISNFSMTVDGKT

SEQ ID NO: 69573 - protein, 8 aa, Homo sapiens
KLGSYEHR

SEQ ID NO: 69574 - protein, 15 aa, Homo sapiens
KLWAYLTINQLLAER

SEQ ID NO: 69575 - protein, 21 aa, Homo sapiens
KVVNNSPQPQNVVFDVQIPKG

SEQ ID NO: 69576 - protein, 14 aa, Homo sapiens
LDQIESVITATSAN

SEQ ID NO: 69577 - protein, 17 aa, Homo sapiens
LDQIESVITATSANTQL

SEQ ID NO: 69578 - protein, 34 aa, Homo sapiens
LDQIESVITATSANTQLVLETLAQMDDLQDFLSK

SEQ ID NO: 69579 - protein, 7 aa, Homo sapiens
LGSYEHR

SEQ ID NO: 69580 - protein, 11 aa, Homo sapiens
LSNENHGIAQR

SEQ ID NO: 69581 - protein, 33 aa, Homo sapiens
LSNENHGIAQRIYGNQDTSSQLKKFYNQVSTPL

SEQ ID NO: 69582 - protein, 10 aa, Homo sapiens
LTINQLLAER

SEQ ID NO: 69583 - protein, 7 aa, Homo sapiens
LVELAPG

SEQ ID NO: 69584 - protein, 11 aa, Homo sapiens
LVIENEAGDER

SEQ ID NO: 69585 - protein, 14 aa, Homo sapiens
LWAYLTINQLLAER

SEQ ID NO: 69586 - protein, 9 aa, Homo sapiens
MATTMIQSK

SEQ ID NO: 69587 - protein, 28 aa, Homo sapiens
MATTMIQSKVVNNSPQPQNVVFDVQIPK

SEQ ID NO: 69588 - protein, 9 aa, Homo sapiens
MKQTVEAMK

SEQ ID NO: 69589 - protein, 22 aa, Homo sapiens
MLADAPPQDPSCCSGALYYGSK

SEQ ID NO: 69590 - protein, 8 aa, Homo sapiens
NDLISATK

SEQ ID NO: 69591 - protein, 16 aa, Homo sapiens
NDLISATKTQVADAKR

SEQ ID NO: 69592 - protein, 16 aa, Homo sapiens
NFHNYFGGSEIVVAGK

SEQ ID NO: 69593 - protein, 18 aa, Homo sapiens
NGYFVHFFAPDNLDPIPK

SEQ ID NO: 69594 - protein, 16 aa, Homo sapiens
NILFVIDVSGSMWGVK

SEQ ID NO: 69595 - protein, 16 aa, Homo sapiens
NSPQPQNVVFDVQIPK

SEQ ID NO: 69596 - protein, 21 aa, Homo sapiens
NTQLVLETLAQMDDLQDFLSK

SEQ ID NO: 69597 - protein, 28 aa, Homo sapiens
NVKENIQDNISLFSLGMGFDVDYDFLKR

SEQ ID NO: 69598 - protein, 8 aa, Homo sapiens
NVQFNYPH

SEQ ID NO: 69599 - protein, 10 aa, Homo sapiens
NVQFNYPHTS

SEQ ID NO: 69600 - protein, 12 aa, Homo sapiens
NVQFNYPHTSVT

SEQ ID NO: 69601 - protein, 17 aa, Homo sapiens
NVQFNYPHTSVTDVTQN

SEQ ID NO: 69602 - protein, 20 aa, Homo sapiens
NVQFNYPHTSVTDVTQNNFH

SEQ ID NO: 69603 - protein, 21 aa, Homo sapiens
NVQFNYPHTSVTDVTQNNFHN

SEQ ID NO: 69604 - protein, 22 aa, Homo sapiens
NVQFNYPHTSVTDVTQNNFHNY

SEQ ID NO: 69605 - protein, 23 aa, Homo sapiens
NVQFNYPHTSVTDVTQNNFHNYF

SEQ ID NO: 69606 - protein, 33 aa, Homo sapiens
NVQFNYPHTSVTDVTQNNFHNYFGGSEIVVAGK

SEQ ID NO: 69607 - protein, 10 aa, Homo sapiens
NVVFDVQIPK

SEQ ID NO: 69608 - protein, 13 aa, Homo sapiens
NYFGGSEIVVAGK

SEQ ID NO: 69609 - protein, 29 aa, Homo sapiens
NYPHTSVTDVTQNNFHNYFGGSEIVVAGK

SEQ ID NO: 69610 - protein, 9 aa, Homo sapiens
PDNLDPIPK

SEQ ID NO: 69611 - protein, 16 aa, Homo sapiens
PDTFEGHFDGVPVISK

SEQ ID NO: 69612 - protein, 21 aa, Homo sapiens
PNSVSLIILVSDGDPTVGELK

SEQ ID NO: 69613 - protein, 17 aa, Homo sapiens
PPQDPSCCSGALYYGSK

SEQ ID NO: 69614 - protein, 13 aa, Homo sapiens
PSCCSGALYYGSK

SEQ ID NO: 69615 - protein, 13 aa, Homo sapiens
PSGGTNINEALLR

SEQ ID NO: 69616 - protein, 27 aa, Homo sapiens
PSPTPVISMLAQGSQVLESTPPPHVMR

SEQ ID NO: 69617 - protein, 7 aa, Homo sapiens
QTVEAMK

SEQ ID NO: 69618 - protein, 12 aa, Homo sapiens
RLSNENHGIAQR

SEQ ID NO: 69619 - protein, 23 aa, Homo sapiens
SANTQLVLETLAQMDDLQDFLSK

SEQ ID NO: 69620 - protein, 15 aa, Homo sapiens
SILQMSLDHHIVTPL

SEQ ID NO: 69621 - protein, 28 aa, Homo sapiens
SILQMSLDHHIVTPLTSLVIENEAGDER

SEQ ID NO: 69622 - protein, 9 aa, Homo sapiens
SLAPTAAAK

SEQ ID NO: 69623 - protein, 23 aa, Homo sapiens
SLDHHIVTPLTSLVIENEAGDER

SEQ ID NO: 69624 - protein, 14 aa, Homo sapiens
SLGMGFDVDYDFLK

SEQ ID NO: 69625 - protein, 15 aa, Homo sapiens
SLGMGFDVDYDFLKR

SEQ ID NO: 69626 - protein, 17 aa, Homo sapiens
SLIILVSDGDPTVGELK

SEQ ID NO: 69627 - protein, 10 aa, Homo sapiens
SNENHGIAQR

SEQ ID NO: 69628 - protein, 15 aa, Homo sapiens
SPQPQNVVFDVQIPK

SEQ ID NO: 69629 - protein, 10 aa, Homo sapiens
SSALDMENFR

SEQ ID NO: 69630 - protein, 10 aa, Homo sapiens
SVIDFNQNIR

SEQ ID NO: 69631 - protein, 19 aa, Homo sapiens
SVSLIILVSDGDPTVGELK

SEQ ID NO: 69632 - protein, 6 aa, Homo sapiens
TAGLVR

SEQ ID NO: 69633 - protein, 10 aa, Homo sapiens
TEVNVLPGAK

SEQ ID NO: 69634 - protein, 21 aa, Homo sapiens
TEVNVLPGAKVQFELHYQEVK

SEQ ID NO: 69635 - protein, 14 aa, Homo sapiens
TFEGHFDGVPVISK

SEQ ID NO: 69636 - protein, 13 aa, Homo sapiens
TFRSSIKEKTVGR

SEQ ID NO: 69637 - protein, 7 aa, Homo sapiens
TILDDLR

SEQ ID NO: 69638 - protein, 22 aa, Homo sapiens
TILDDLRAEDHFSVIDFNQNIR

SEQ ID NO: 69639 - protein, 9 aa, Homo sapiens
TINQLLAER

SEQ ID NO: 69640 - protein, 20 aa, Homo sapiens
TQLVLETLAQMDDLQDFLSK

SEQ ID NO: 69641 - protein, 7 aa, Homo sapiens
TQVADAK

SEQ ID NO: 69642 - protein, 24 aa, Homo sapiens
TSANTQLVLETLAQMDDLQDFLSK

SEQ ID NO: 69643 - protein, 13 aa, Homo sapiens
TSLVIENEAGDER

SEQ ID NO: 69644 - protein, 25 aa, Homo sapiens
TSVTDVTQNNFHNYFGGSEIVVAGK

SEQ ID NO: 69645 - protein, 11 aa, Homo sapiens
TVGRALYAQAR

SEQ ID NO: 69646 - protein, 11 aa, Homo sapiens
TWRNDLISATK

SEQ ID NO: 69647 - protein, 18 aa, Homo sapiens
TWRNDLISATKTQVADAK

SEQ ID NO: 69648 - protein, 19 aa, Homo sapiens
TWRNDLISATKTQVADAKR

SEQ ID NO: 69649 - protein, 14 aa, Homo sapiens
VHFFAPDNLDPIPK

SEQ ID NO: 69650 - protein, 12 aa, Homo sapiens
VIDVSGSMWGVK

SEQ ID NO: 69651 - protein, 17 aa, Homo sapiens
VLETLAQMDDLQDFLSK

SEQ ID NO: 69652 - protein, 11 aa, Homo sapiens
VQFELHYQEVK

SEQ ID NO: 69653 - protein, 8 aa, Homo sapiens
VQSTITSR

SEQ ID NO: 69654 - protein, 11 aa, Homo sapiens
VSFKPTVAQQR

SEQ ID NO: 69655 - protein, 9 aa, Homo sapiens
VVFDVQIPK

SEQ ID NO: 69656 - protein, 13 aa, Homo sapiens
VVNNSPQPQNVVF

SEQ ID NO: 69657 - protein, 19 aa, Homo sapiens
VVNNSPQPQNVVFDVQIPK

SEQ ID NO: 69658 - protein, 13 aa, Homo sapiens
WAYLTINQLLAER

SEQ ID NO: 69659 - protein, 12 aa, Homo sapiens
YFGGSEIVVAGK

SEQ ID NO: 69660 - protein, 19 aa, Homo sapiens
YIEKIQPSGGTNINEALLR

SEQ ID NO: 69661 - protein, 28 aa, Homo sapiens
YPHTSVTDVTQNNFHNYFGGSEIVVAGK

SEQ ID NO: 69662 - protein, 18 aa, Homo sapiens
AIADKPGEDAEATPVSPA

SEQ ID NO: 69663 - protein, 21 aa, Homo sapiens
AIADKPGEDAEATPVSPAMSY

SEQ ID NO: 69664 - protein, 7 aa, Homo sapiens
ALDLSLK

SEQ ID NO: 69665 - protein, 15 aa, Homo sapiens
ALQERDYIFGNYIER

SEQ ID NO: 69666 - protein, 12 aa, Homo sapiens
DFLGFYVVDSHR

SEQ ID NO: 69667 - protein, 10 aa, Homo sapiens
DYIFGNYIER

SEQ ID NO: 69668 - protein, 18 aa, Homo sapiens
EEDYLNFILFSGDVSTWK

SEQ ID NO: 69669 - protein, 15 aa, Homo sapiens
EHLVQATPENLQEAR

SEQ ID NO: 69670 - protein, 12 aa, Homo sapiens
ESPGNVQIVNGY

SEQ ID NO: 69671 - protein, 16 aa, Homo sapiens
ESPGNVQIVNGYFVHF

SEQ ID NO: 69672 - protein, 27 aa, Homo sapiens
ESPGNVQIVNGYFVHFFAPQGLPVVPK

SEQ ID NO: 69673 - protein, 10 aa, Homo sapiens
EVSFDVELPK

SEQ ID NO: 69674 - protein, 9 aa, Homo sapiens
FAHNVVTMR

SEQ ID NO: 69675 - protein, 15 aa, Homo sapiens
FPLYNLGFGNNLNYN

SEQ ID NO: 69676 - protein, 29 aa, Homo sapiens
FPLYNLGFGNNLNYNFLENMALENHGFAR

SEQ ID NO: 69677 - protein, 12 aa, Homo sapiens
FTVSVNVAAGSK

SEQ ID NO: 69678 - protein, 12 aa, Homo sapiens
FYDGSEIVVAGR

SEQ ID NO: 69679 - protein, 17 aa, Homo sapiens
GHGATNDLTFTEEVDMK

SEQ ID NO: 69680 - protein, 13 aa, Homo sapiens
GHVSFKPSLDQQR

SEQ ID NO: 69681 - protein, 11 aa, Homo sapiens
GMTNINDGLLR

SEQ ID NO: 69682 - protein, 18 aa, Homo sapiens
GMTNINDGLLRGISMLNK

SEQ ID NO: 69683 - protein, 17 aa, Homo sapiens
GYFVHFFAPQGLPVVPK

SEQ ID NO: 69684 - protein, 35 aa, Homo sapiens
HFEIEVDIFEPQGISMLDAEASFITNDLLGSALTK

SEQ ID NO: 69685 - protein, 10 aa, Homo sapiens
HKGKYEMYLK

SEQ ID NO: 69686 - protein, 24 aa, Homo sapiens
ILEDMKEEDYLNFILFSGDVSTWK

SEQ ID NO: 69687 - protein, 11 aa, Homo sapiens
ILFSGDVSTWK

SEQ ID NO: 69688 - protein, 12 aa, Homo sapiens
ITNDLLGSALTK

SEQ ID NO: 69689 - protein, 14 aa, Homo sapiens
KGHVSFKPSLDQQR

SEQ ID NO: 69690 - protein, 11 aa, Homo sapiens
KLEQTKEALLR

SEQ ID NO: 69691 - protein, 15 aa, Homo sapiens
KNAHGEEKENLTARA

SEQ ID NO: 69692 - protein, 23 aa, Homo sapiens
KTAFITNFTLTIDGVTYPGNVKE

SEQ ID NO: 69693 - protein, 19 aa, Homo sapiens
LIQDAVTGLTVNGQITGDK

SEQ ID NO: 69694 - protein, 15 aa, Homo sapiens
LTDGDANVGESRPEK

SEQ ID NO: 69695 - protein, 10 aa, Homo sapiens
LVDEDMNSFK

SEQ ID NO: 69696 - protein, 14 aa, Homo sapiens
LVDEDMNSFKADVK

SEQ ID NO: 69697 - protein, 13 aa, Homo sapiens
LWAYLTIEQLLEK

SEQ ID NO: 69698 - protein, 10 aa, Homo sapiens
MALENHGFAR

SEQ ID NO: 69699 - protein, 35 aa, Homo sapiens
NAIGGKFPLYNLGFGNNLNYNFLENMALENHGFAR

SEQ ID NO: 69700 - protein, 15 aa, Homo sapiens
NVAFVIDISGSMAGR

SEQ ID NO: 69701 - protein, 27 aa, Homo sapiens
PENAILDLTQNTYQHFYDGSEIVVAGR

SEQ ID NO: 69702 - protein, 14 aa, Homo sapiens
QHFYDGSEIVVAGR

SEQ ID NO: 69703 - protein, 23 aa, Homo sapiens
RSCPTCTDSLLNGDFTITYDVNR

SEQ ID NO: 69704 - protein, 22 aa, Homo sapiens
SCPTCTDSLLNGDFTITYDVNR

SEQ ID NO: 69705 - protein, 19 aa, Homo sapiens
SFSGKKGHVSFKPSLDQQR

SEQ ID NO: 69706 - protein, 13 aa, Homo sapiens
SLPEGVANGIEVY

SEQ ID NO: 69707 - protein, 16 aa, Homo sapiens
SLPEGVANGIEVYSTK

SEQ ID NO: 69708 - protein, 20 aa, Homo sapiens
SLPEGVANGIEVYSTKINSK

SEQ ID NO: 69709 - protein, 16 aa, Homo sapiens
SMEDKGMTNINDGLLR

SEQ ID NO: 69710 - protein, 23 aa, Homo sapiens
SMEDKGMTNINDGLLRGISMLNK

SEQ ID NO: 69711 - protein, 19 aa, Homo sapiens
STSIVIMLTDGDANVGESR

SEQ ID NO: 69712 - protein, 22 aa, Homo sapiens
STSIVIMLTDGDANVGESRPEK

SEQ ID NO: 69713 - protein, 20 aa, Homo sapiens
TFVKSMEDKGMTNINDGLLR

SEQ ID NO: 69714 - protein, 14 aa, Homo sapiens
TLTIDGVTYPGNVK

SEQ ID NO: 69715 - protein, 15 aa, Homo sapiens
TSMVVTKPEDNEDER

SEQ ID NO: 69716 - protein, 16 aa, Homo sapiens
TYQHFYDGSEIVVAGR

SEQ ID NO: 69717 - protein, 11 aa, Homo sapiens
VIDISGSMAGR

SEQ ID NO: 69718 - protein, 20 aa, Homo sapiens
VSDIRPGSDPTKPDATLVVK

SEQ ID NO: 69719 - protein, 12 aa, Homo sapiens
VTFELTYEELLK

SEQ ID NO: 69720 - protein, 13 aa, Homo sapiens
VTFELTYEELLKR

SEQ ID NO: 69721 - protein, 12 aa, Homo sapiens
VVTKPEDNEDER

SEQ ID NO: 69722 - protein, 6 aa, Homo sapiens
YEELLK

SEQ ID NO: 69723 - protein, 22 aa, Homo sapiens
YHFVTPLTSMVVTKPEDNEDER

SEQ ID NO: 69724 - protein, 13 aa, Homo sapiens
AEAQAQYSAAVAK

SEQ ID NO: 69725 - protein, 15 aa, Homo sapiens
AEAQAQYSAAVAKGK

SEQ ID NO: 69726 - protein, 11 aa, Homo sapiens
AEQEAEFQSPK

SEQ ID NO: 69727 - protein, 11 aa, Homo sapiens
AGFSWIEVTFK

SEQ ID NO: 69728 - protein, 28 aa, Homo sapiens
AGFSWIEVTFKNPLVWVHASPEHVVVTR

SEQ ID NO: 69729 - protein, 12 aa, Homo sapiens
AILPLPGQSVER

SEQ ID NO: 69730 - protein, 16 aa, Homo sapiens
AISGGSIQIENGYFVH

SEQ ID NO: 69731 - protein, 17 aa, Homo sapiens
AISGGSIQIENGYFVHY

SEQ ID NO: 69732 - protein, 23 aa, Homo sapiens
AISGGSIQIENGYFVHYFAPEGL

SEQ ID NO: 69733 - protein, 28 aa, Homo sapiens
AISGGSIQIENGYFVHYFAPEGLTTMPK

SEQ ID NO: 69734 - protein, 9 aa, Homo sapiens
ANTVQEATF

SEQ ID NO: 69735 - protein, 15 aa, Homo sapiens
ANTVQEATFQMELPK

SEQ ID NO: 69736 - protein, 16 aa, Homo sapiens
ANTVQEATFQMELPKK

SEQ ID NO: 69737 - protein, 10 aa, Homo sapiens
ASDADQQALR

SEQ ID NO: 69738 - protein, 10 aa, Homo sapiens
ASPEHVVVTR

SEQ ID NO: 69739 - protein, 11 aa, Homo sapiens
AVEEVTQNNFR

SEQ ID NO: 69740 - protein, 13 aa, Homo sapiens
AVQLLDSSNQEER

SEQ ID NO: 69741 - protein, 20 aa, Homo sapiens
AVTFEYPSNAVEEVTQNNFR

SEQ ID NO: 69742 - protein, 34 aa, Homo sapiens
AYSFVTPLTSMVVTKPDDQEQSQVAEKPMEGESR

SEQ ID NO: 69743 - protein, 15 aa, Homo sapiens
CLGFGFDVSYAFLEK

SEQ ID NO: 69744 - protein, 17 aa, Homo sapiens
DQEQSQVAEKPMEGESR

SEQ ID NO: 69745 - protein, 16 aa, Homo sapiens
DQFNLIVFSTEATQWR

SEQ ID NO: 69746 - protein, 29 aa, Homo sapiens
DQFNLIVFSTEATQWRPSLVPASAENVNK

SEQ ID NO: 69747 - protein, 14 aa, Homo sapiens
DRGPDVLTATVSGK

SEQ ID NO: 69748 - protein, 32 aa, Homo sapiens
DTDRFSSHVGGTLGQFYQEVLWGSPAASDDGR

SEQ ID NO: 69749 - protein, 33 aa, Homo sapiens
DTDRFSSHVGGTLGQFYQEVLWGSPAASDDGRR

SEQ ID NO: 69750 - protein, 10 aa, Homo sapiens
DVLTATVSGK

SEQ ID NO: 69751 - protein, 13 aa, Homo sapiens
EALIKILDDLSPR

SEQ ID NO: 69752 - protein, 15 aa, Homo sapiens
EKAEAQAQYSAAVAK

SEQ ID NO: 69753 - protein, 17 aa, Homo sapiens
EKAEAQAQYSAAVAKGK

SEQ ID NO: 69754 - protein, 30 aa, Homo sapiens
EKAGFSWIEVTFKNPLVWVHASPEHVVVTR

SEQ ID NO: 69755 - protein, 15 aa, Homo sapiens
EKNGIDIYSLTVDSR

SEQ ID NO: 69756 - protein, 15 aa, Homo sapiens
ESSVAEQEAEFQSPK

SEQ ID NO: 69757 - protein, 11 aa, Homo sapiens
ETLFSVMPGLK

SEQ ID NO: 69758 - protein, 16 aa, Homo sapiens
EYPSNAVEEVTQNNFR

SEQ ID NO: 69759 - protein, 9 aa, Homo sapiens
FAHTVVTSR

SEQ ID NO: 69760 - protein, 11 aa, Homo sapiens
FAPEGLTTMPK

SEQ ID NO: 69761 - protein, 7 aa, Homo sapiens
FHNFMER

SEQ ID NO: 69762 - protein, 11 aa, Homo sapiens
FKGSEMVVAGK

SEQ ID NO: 69763 - protein, 10 aa, Homo sapiens
FKPTLSQQQK

SEQ ID NO: 69764 - protein, 26 aa, Homo sapiens
FKPTLSQQQKSPEQQETVLDGNLIIR

SEQ ID NO: 69765 - protein, 11 aa, Homo sapiens
FSSHVGGTLGQ

SEQ ID NO: 69766 - protein, 12 aa, Homo sapiens
FSSHVGGTLGQF

SEQ ID NO: 69767 - protein, 17 aa, Homo sapiens
FSSHVGGTLGQFYQEVL

SEQ ID NO: 69768 - protein, 22 aa, Homo sapiens
FSSHVGGTLGQFYQEVLWGSPA

SEQ ID NO: 69769 - protein, 28 aa, Homo sapiens
FSSHVGGTLGQFYQEVLWGSPAASDDGR

SEQ ID NO: 69770 - protein, 29 aa, Homo sapiens
FSSHVGGTLGQFYQEVLWGSPAASDDGRR

SEQ ID NO: 69771 - protein, 17 aa, Homo sapiens
FYQEVLWGSPAASDDGR

SEQ ID NO: 69772 - protein, 11 aa, Homo sapiens
GFDVSYAFLEK

SEQ ID NO: 69773 - protein, 12 aa, Homo sapiens
GIDIYSLTVDSR

SEQ ID NO: 69774 - protein, 12 aa, Homo sapiens
GPDVLTATVSGK

SEQ ID NO: 69775 - protein, 37 aa, Homo sapiens
GPDVLTATVSGKLPTQNITFQTESSVAEQEAEFQSPK

SEQ ID NO: 69776 - protein, 15 aa, Homo sapiens
GPPDVPDHAAYHPFR

SEQ ID NO: 69777 - protein, 21 aa, Homo sapiens
GPVNLLSDPEQGVEVTGQYER

SEQ ID NO: 69778 - protein, 9 aa, Homo sapiens
GSEMVVAGK

SEQ ID NO: 69779 - protein, 13 aa, Homo sapiens
GSEMVVAGKLQDR

SEQ ID NO: 69780 - protein, 12 aa, Homo sapiens
GWNRQAGAAGSR

SEQ ID NO: 69781 - protein, 8 aa, Homo sapiens
HAAYHPFR

SEQ ID NO: 69782 - protein, 7 aa, Homo sapiens
HLQMDIH

SEQ ID NO: 69783 - protein, 12 aa, Homo sapiens
HLQMDIHIFEPQ

SEQ ID NO: 69784 - protein, 24 aa, Homo sapiens
HRQGPVNLLSDPEQGVEVTGQYER

SEQ ID NO: 69785 - protein, 26 aa, Homo sapiens
HRQGPVNLLSDPEQGVEVTGQYEREK

SEQ ID NO: 69786 - protein, 30 aa, Homo sapiens
IEETTMTTQTPAPIQAPSAILPLPGQSVER

SEQ ID NO: 69787 - protein, 9 aa, Homo sapiens
IGLLFWDGR

SEQ ID NO: 69788 - protein, 12 aa, Homo sapiens
IHEDSDSALQLQ

SEQ ID NO: 69789 - protein, 22 aa, Homo sapiens
IHEDSDSALQLQDFYQEVANPL

SEQ ID NO: 69790 - protein, 23 aa, Homo sapiens
IHEDSDSALQLQDFYQEVANPLL

SEQ ID NO: 69791 - protein, 24 aa, Homo sapiens
IHEDSDSALQLQDFYQEVANPLLT

SEQ ID NO: 69792 - protein, 28 aa, Homo sapiens
IHEDSDSALQLQDFYQEVANPLLTAVTF

SEQ ID NO: 69793 - protein, 44 aa, Homo sapiens
IHEDSDSALQLQDFYQEVANPLLTAVTFEYPSNAVEEVTQNNFR

SEQ ID NO: 69794 - protein, 17 aa, Homo sapiens
IILLTDGDPTVGETNPR

SEQ ID NO: 69795 - protein, 8 aa, Homo sapiens
ILDDLSPR

SEQ ID NO: 69796 - protein, 8 aa, Homo sapiens
IPKPEASF

SEQ ID NO: 69797 - protein, 11 aa, Homo sapiens
IPKPEASFSPR

SEQ ID NO: 69798 - protein, 20 aa, Homo sapiens
IQQLLEQTVSASDADQQALR

SEQ ID NO: 69799 - protein, 12 aa, Homo sapiens
ITFELVYEELLK

SEQ ID NO: 69800 - protein, 13 aa, Homo sapiens
ITFELVYEELLKR

SEQ ID NO: 69801 - protein, 20 aa, Homo sapiens
ITFQTESSVAEQEAEFQSPK

SEQ ID NO: 69802 - protein, 40 aa, Homo sapiens
KHLQMDIHIFEPQGISFLETESTFMTNQLVDALTTWQNKT

SEQ ID NO: 69803 - protein, 27 aa, Homo sapiens
KLPTQNITFQTESSVAEQEAEFQSPKY

SEQ ID NO: 69804 - protein, 21 aa, Homo sapiens
LAILPASAPPATSNPDPAVSR

SEQ ID NO: 69805 - protein, 10 aa, Homo sapiens
LALDNGGLAR

SEQ ID NO: 69806 - protein, 6 aa, Homo sapiens
LCVDPR

SEQ ID NO: 69807 - protein, 19 aa, Homo sapiens
LDYQEGPPGVEISCWSVEL

SEQ ID NO: 69808 - protein, 9 aa, Homo sapiens
LGVYELLLK

SEQ ID NO: 69809 - protein, 18 aa, Homo sapiens
LIILLTDGDPTVGETNPR

SEQ ID NO: 69810 - protein, 10 aa, Homo sapiens
LLDSSNQEER

SEQ ID NO: 69811 - protein, 17 aa, Homo sapiens
LLEQTVSASDADQQALR

SEQ ID NO: 69812 - protein, 13 aa, Homo sapiens
LLFKGSEMVVAGK

SEQ ID NO: 69813 - protein, 8 aa, Homo sapiens
LLLRDTDR

SEQ ID NO: 69814 - protein, 17 aa, Homo sapiens
LLSDPEQGVEVTGQYER

SEQ ID NO: 69815 - protein, 15 aa, Homo sapiens
LMAVQLLDSSNQEER

SEQ ID NO: 69816 - protein, 25 aa, Homo sapiens
LPEGSVSLIILLTDGDPTVGETNPR

SEQ ID NO: 69817 - protein, 25 aa, Homo sapiens
LPTQNITFQTESSVAEQEAEFQSPK

SEQ ID NO: 69818 - protein, 16 aa, Homo sapiens
LQDRGPDVLTATVSGK

SEQ ID NO: 69819 - protein, 22 aa, Homo sapiens
LTAVTFEYPSNAVEEVTQNNFR

SEQ ID NO: 69820 - protein, 14 aa, Homo sapiens
LTDGDPTVGETNPR

SEQ ID NO: 69821 - protein, 22 aa, Homo sapiens
LTIQQLLEQTVSASDADQQALR

SEQ ID NO: 69822 - protein, 11 aa, Homo sapiens
LVPASAENVNK

SEQ ID NO: 69823 - protein, 15 aa, Homo sapiens
LVWVHASPEHVVVTR

SEQ ID NO: 69824 - protein, 13 aa, Homo sapiens
LWAYLTIQQLLEQ

SEQ ID NO: 69825 - protein, 26 aa, Homo sapiens
LWAYLTIQQLLEQTVSASDADQQALR

SEQ ID NO: 69826 - protein, 14 aa, Homo sapiens
MAVQLLDSSNQEER

SEQ ID NO: 69827 - protein, 11 aa, Homo sapiens
MNFRPGVLSSR

SEQ ID NO: 69828 - protein, 24 aa, Homo sapiens
MVVTKPDDQEQSQVAEKPMEGESR

SEQ ID NO: 69829 - protein, 12 aa, Homo sapiens
NAVEEVTQNNFR

SEQ ID NO: 69830 - protein, 13 aa, Homo sapiens
NGIDIYSLTVDSR

SEQ ID NO: 69831 - protein, 16 aa, Homo sapiens
NMEQFQVSVSVAPNAK

SEQ ID NO: 69832 - protein, 7 aa, Homo sapiens
NPLVWVH

SEQ ID NO: 69833 - protein, 17 aa, Homo sapiens
NPLVWVHASPEHVVVTR

SEQ ID NO: 69834 - protein, 25 aa, Homo sapiens
NQALNLSLAYSFVTPLTSMVVTKPD

SEQ ID NO: 69835 - protein, 42 aa, Homo sapiens
NQALNLSLAYSFVTPLTSMVVTKPDDQEQSQVAEKPMEGESR

SEQ ID NO: 69836 - protein, 14 aa, Homo sapiens
NQLVDALTTWQNKT

SEQ ID NO: 69837 - protein, 12 aa, Homo sapiens
NRNVHSGSTFFK

SEQ ID NO: 69838 - protein, 19 aa, Homo sapiens
NRNVHSGSTFFKYYLQGAK

SEQ ID NO: 69839 - protein, 10 aa, Homo sapiens
NVHSGSTFFK

SEQ ID NO: 69840 - protein, 17 aa, Homo sapiens
NVHSGSTFFKYYLQGAK

SEQ ID NO: 69841 - protein, 8 aa, Homo sapiens
NVVFVIDK

SEQ ID NO: 69842 - protein, 15 aa, Homo sapiens
NVVFVIDKSGSMSGR

SEQ ID NO: 69843 - protein, 19 aa, Homo sapiens
PDDQEQSQVAEKPMEGESR

SEQ ID NO: 69844 - protein, 11 aa, Homo sapiens
PDVLTATVSGK

SEQ ID NO: 69845 - protein, 13 aa, Homo sapiens
PDVPDHAAYHPFR

SEQ ID NO: 69846 - protein, 8 aa, Homo sapiens
PEASFSPR

SEQ ID NO: 69847 - protein, 9 aa, Homo sapiens
PEGLTTMPK

SEQ ID NO: 69848 - protein, 13 aa, Homo sapiens
PEQGVEVTGQYER

SEQ ID NO: 69849 - protein, 15 aa, Homo sapiens
PEQGVEVTGQYEREK

SEQ ID NO: 69850 - protein, 16 aa, Homo sapiens
PGPPDVPDHAAYHPFR

SEQ ID NO: 69851 - protein, 17 aa, Homo sapiens
PGPPDVPDHAAYHPFRR

SEQ ID NO: 69852 - protein, 24 aa, Homo sapiens
PLLTAVTFEYPSNAVEEVTQNNFR

SEQ ID NO: 69853 - protein, 28 aa, Homo sapiens
PLTSMVVTKPDDQEQSQVAEKPMEGESR

SEQ ID NO: 69854 - protein, 16 aa, Homo sapiens
PLVWVHASPEHVVVTR

SEQ ID NO: 69855 - protein, 14 aa, Homo sapiens
PPDVPDHAAYHPFR

SEQ ID NO: 69856 - protein, 15 aa, Homo sapiens
PPDVPDHAAYHPFRR

SEQ ID NO: 69857 - protein, 13 aa, Homo sapiens
PSLVPASAENVNK

SEQ ID NO: 69858 - protein, 8 aa, Homo sapiens
PTLSQQQK

SEQ ID NO: 69859 - protein, 24 aa, Homo sapiens
PTQNITFQTESSVAEQEAEFQSPK

SEQ ID NO: 69860 - protein, 19 aa, Homo sapiens
QAGAAGSRMNFRPGVLSSR

SEQ ID NO: 69861 - protein, 33 aa, Homo sapiens
QDFYQEVANPLLTAVTFEYPSNAVEEVTQNNFR

SEQ ID NO: 69862 - protein, 15 aa, Homo sapiens
QEVLWGSPAASDDGR

SEQ ID NO: 69863 - protein, 22 aa, Homo sapiens
QGPVNLLSDPEQGVEVTGQYER

SEQ ID NO: 69864 - protein, 24 aa, Homo sapiens
QGPVNLLSDPEQGVEVTGQYEREK

SEQ ID NO: 69865 - protein, 19 aa, Homo sapiens
QLGLPGPPDVPDHAAYHPF

SEQ ID NO: 69866 - protein, 20 aa, Homo sapiens
QLGLPGPPDVPDHAAYHPFR

SEQ ID NO: 69867 - protein, 21 aa, Homo sapiens
QLGLPGPPDVPDHAAYHPFRR

SEQ ID NO: 69868 - protein, 18 aa, Homo sapiens
QLLEQTVSASDADQQALR

SEQ ID NO: 69869 - protein, 17 aa, Homo sapiens
QTESSVAEQEAEFQSPK

SEQ ID NO: 69870 - protein, 29 aa, Homo sapiens
RIHEDSDSALQLQDFYQEVANPLLTAVTF

SEQ ID NO: 69871 - protein, 44 aa, Homo sapiens
RIHEDSDSALQLQDFYQEVANPLLTAVTFEYPSNAVEEVTQNNF

SEQ ID NO: 69872 - protein, 45 aa, Homo sapiens
RIHEDSDSALQLQDFYQEVANPLLTAVTFEYPSNAVEEVTQNNFR

SEQ ID NO: 69873 - protein, 25 aa, Homo sapiens
RLAILPASAPPATSNPDPAVSRVMN

SEQ ID NO: 69874 - protein, 14 aa, Homo sapiens
RLDYQEGPPGVEIS

SEQ ID NO: 69875 - protein, 20 aa, Homo sapiens
RLDYQEGPPGVEISCWSVEL

SEQ ID NO: 69876 - protein, 10 aa, Homo sapiens
RLGVYELLLK

SEQ ID NO: 69877 - protein, 12 aa, Homo sapiens
RNQALNLSLAYS

SEQ ID NO: 69878 - protein, 44 aa, Homo sapiens
RNQALNLSLAYSFVTPLTSMVVTKPDDQEQSQVAEKPMEGESRN

SEQ ID NO: 69879 - protein, 14 aa, Homo sapiens
RPSLVPASAENVNK

SEQ ID NO: 69880 - protein, 10 aa, Homo sapiens
SAGLVKATGR

SEQ ID NO: 69881 - protein, 15 aa, Homo sapiens
SDPEQGVEVTGQYER

SEQ ID NO: 69882 - protein, 19 aa, Homo sapiens
SFAAGIQALGGTNINDAML

SEQ ID NO: 69883 - protein, 33 aa, Homo sapiens
SFAAGIQALGGTNINDAMLMAVQLLDSSNQEER

SEQ ID NO: 69884 - protein, 32 aa, Homo sapiens
SFVTPLTSMVVTKPDDQEQSQVAEKPMEGESR

SEQ ID NO: 69885 - protein, 7 aa, Homo sapiens
SIQNNVR

SEQ ID NO: 69886 - protein, 9 aa, Homo sapiens
SPEHVVVTR

SEQ ID NO: 69887 - protein, 12 aa, Homo sapiens
SPEQQETVLDGN

SEQ ID NO: 69888 - protein, 16 aa, Homo sapiens
SPEQQETVLDGNLIIR

SEQ ID NO: 69889 - protein, 21 aa, Homo sapiens
SPEQQETVLDGNLIIRYDVDR

SEQ ID NO: 69890 - protein, 18 aa, Homo sapiens
SSAYKWKETLFSVMPGLK

SEQ ID NO: 69891 - protein, 14 aa, Homo sapiens
SSVAEQEAEFQSPK

SEQ ID NO: 69892 - protein, 21 aa, Homo sapiens
STEATQWRPSLVPASAENVNK

SEQ ID NO: 69893 - protein, 13 aa, Homo sapiens
SVAEQEAEFQSPK

SEQ ID NO: 69894 - protein, 21 aa, Homo sapiens
TAVTFEYPSNAVEEVTQNNFR

SEQ ID NO: 69895 - protein, 16 aa, Homo sapiens
TESSVAEQEAEFQSPK

SEQ ID NO: 69896 - protein, 11 aa, Homo sapiens
TGLLLLSDPDK

SEQ ID NO: 69897 - protein, 18 aa, Homo sapiens
TGLLLLSDPDKVTIGLLF

SEQ ID NO: 69898 - protein, 22 aa, Homo sapiens
TGLLLLSDPDKVTIGLLFWDGR

SEQ ID NO: 69899 - protein, 27 aa, Homo sapiens
TGLLLLSDPDKVTIGLLFWDGRGEGLR

SEQ ID NO: 69900 - protein, 21 aa, Homo sapiens
TIQQLLEQTVSASDADQQALR

SEQ ID NO: 69901 - protein, 13 aa, Homo sapiens
TLRVQGNDHSATR

SEQ ID NO: 69902 - protein, 15 aa, Homo sapiens
TLRVQGNDHSATRER

SEQ ID NO: 69903 - protein, 22 aa, Homo sapiens
TNINDAMLMAVQLLDSSNQEER

SEQ ID NO: 69904 - protein, 21 aa, Homo sapiens
TPAPIQAPSAILPLPGQSVER

SEQ ID NO: 69905 - protein, 29 aa, Homo sapiens
TPLTSMVVTKPDDQEQSQVAEKPMEGESR

SEQ ID NO: 69906 - protein, 23 aa, Homo sapiens
TQNITFQTESSVAEQEAEFQSPK

SEQ ID NO: 69907 - protein, 26 aa, Homo sapiens
TSMVVTKPDDQEQSQVAEKPMEGESR

SEQ ID NO: 69908 - protein, 13 aa, Homo sapiens
TVQEATFQMELPK

SEQ ID NO: 69909 - protein, 13 aa, Homo sapiens
TVSASDADQQALR

SEQ ID NO: 69910 - protein, 12 aa, Homo sapiens
VAEQEAEFQSPK

SEQ ID NO: 69911 - protein, 27 aa, Homo sapiens
VANPLLTAVTFEYPSNAVEEVTQNNFR

SEQ ID NO: 69912 - protein, 24 aa, Homo sapiens
VGGTLGQFYQEVLWGSPAASDDGR

SEQ ID NO: 69913 - protein, 12 aa, Homo sapiens
VHASPEHVVVTR

SEQ ID NO: 69914 - protein, 14 aa, Homo sapiens
VHYFAPEGLTTMPK

SEQ ID NO: 69915 - protein, 9 aa, Homo sapiens
VLDGNLIIR

SEQ ID NO: 69916 - protein, 11 aa, Homo sapiens
VPDHAAYHPFR

SEQ ID NO: 69917 - protein, 10 aa, Homo sapiens
VQGNDHSATR

SEQ ID NO: 69918 - protein, 12 aa, Homo sapiens
VQLLDSSNQEER

SEQ ID NO: 69919 - protein, 8 aa, Homo sapiens
VRPQQLVK

SEQ ID NO: 69920 - protein, 19 aa, Homo sapiens
VTFEYPSNAVEEVTQNNFR

SEQ ID NO: 69921 - protein, 11 aa, Homo sapiens
VTIGLLFWDGR

SEQ ID NO: 69922 - protein, 30 aa, Homo sapiens
VTPLTSMVVTKPDDQEQSQVAEKPMEGESR

SEQ ID NO: 69923 - protein, 19 aa, Homo sapiens
VVNRANTVQEATFQMELPK

SEQ ID NO: 69924 - protein, 23 aa, Homo sapiens
VVTKPDDQEQSQVAEKPMEGESR

SEQ ID NO: 69925 - protein, 11 aa, Homo sapiens
WGSPAASDDGR

SEQ ID NO: 69926 - protein, 13 aa, Homo sapiens
WKETLFSVMPGLK

SEQ ID NO: 69927 - protein, 15 aa, Homo sapiens
WRPSLVPASAENVNK

SEQ ID NO: 69928 - protein, 13 aa, Homo sapiens
WVHASPEHVVVTR

SEQ ID NO: 69929 - protein, 12 aa, Homo sapiens
YFAPEGLTTMPK

SEQ ID NO: 69930 - protein, 9 aa, Homo sapiens
YIFHNFMER

SEQ ID NO: 69931 - protein, 33 aa, Homo sapiens
YSFVTPLTSMVVTKPDDQEQSQVAEKPMEGESR

SEQ ID NO: 69932 - protein, 7 aa, Homo sapiens
YYLQGAK

SEQ ID NO: 69933 - protein, 24 aa, Homo sapiens
ALSEIGCHMNIFQHLAFSDVDVAR

SEQ ID NO: 69934 - protein, 17 aa, Homo sapiens
APLNYTEFQKPICLPSK

SEQ ID NO: 69935 - protein, 17 aa, Homo sapiens
CLLFSFLPASSINDMEK

SEQ ID NO: 69936 - protein, 18 aa, Homo sapiens
CLLFSFLPASSINDMEKR

SEQ ID NO: 69937 - protein, 13 aa, Homo sapiens
CQFFSYATQTFHK

SEQ ID NO: 69938 - protein, 14 aa, Homo sapiens
CQFFTYSLLPEDCK

SEQ ID NO: 69939 - protein, 17 aa, Homo sapiens
CQFFTYSLLPEDCKEEK

SEQ ID NO: 69940 - protein, 14 aa, Homo sapiens
DACKGDSGGPLVCK

SEQ ID NO: 69941 - protein, 9 aa, Homo sapiens
DIYKGVDMR

SEQ ID NO: 69942 - protein, 9 aa, Homo sapiens
DSVTGTLPK

SEQ ID NO: 69943 - protein, 8 aa, Homo sapiens
DTPFSQIK

SEQ ID NO: 69944 - protein, 9 aa, Homo sapiens
EIIIHQNYK

SEQ ID NO: 69945 - protein, 11 aa, Homo sapiens
EKGEIQNILQK

SEQ ID NO: 69946 - protein, 6 aa, Homo sapiens
FGCFLK

SEQ ID NO: 69947 - protein, 15 aa, Homo sapiens
FGCFLKDSVTGTLPK

SEQ ID NO: 69948 - protein, 13 aa, Homo sapiens
GCLTQLYENAFFR

SEQ ID NO: 69949 - protein, 10 aa, Homo sapiens
GDSGGPLVCK

SEQ ID NO: 69950 - protein, 19 aa, Homo sapiens
GDTSTIYTNCWVTGWGFSK

SEQ ID NO: 69951 - protein, 9 aa, Homo sapiens
GEIQNILQK

SEQ ID NO: 69952 - protein, 18 aa, Homo sapiens
GGDVASMYTPNAQYCQMR

SEQ ID NO: 69953 - protein, 8 aa, Homo sapiens
GVNFNVSK

SEQ ID NO: 69954 - protein, 18 aa, Homo sapiens
GVNFNVSKVSSVEECQKR

SEQ ID NO: 69955 - protein, 11 aa, Homo sapiens
GVNVCQETCTK

SEQ ID NO: 69956 - protein, 11 aa, Homo sapiens
HLAFSDVDVAR

SEQ ID NO: 69957 - protein, 18 aa, Homo sapiens
HLCGGSLIGHQWVLTAAH

SEQ ID NO: 69958 - protein, 30 aa, Homo sapiens
HLCGGSLIGHQWVLTAAHCFDGLPLQDVWR

SEQ ID NO: 69959 - protein, 6 aa, Homo sapiens
HNGMWR

SEQ ID NO: 69960 - protein, 11 aa, Homo sapiens
IAYGTQGSSGY

SEQ ID NO: 69961 - protein, 14 aa, Homo sapiens
IAYGTQGSSGYSLR

SEQ ID NO: 69962 - protein, 14 aa, Homo sapiens
IFQHLAFSDVDVAR

SEQ ID NO: 69963 - protein, 21 aa, Homo sapiens
IVGGTNSSWGEWPWQVSLQVK

SEQ ID NO: 69964 - protein, 18 aa, Homo sapiens
IYPGVDFGGEELNVTFVK

SEQ ID NO: 69965 - protein, 13 aa, Homo sapiens
IYSGILNLSDITK

SEQ ID NO: 69966 - protein, 21 aa, Homo sapiens
IYSGILNLSDITKDTPFSQIK

SEQ ID NO: 69967 - protein, 30 aa, Homo sapiens
IYSGILNLSDITKDTPFSQIKEIIIHQNYK

SEQ ID NO: 69968 - protein, 20 aa, Homo sapiens
KIYPGVDFGGEELNVTFVKG

SEQ ID NO: 69969 - protein, 14 aa, Homo sapiens
KLQAPLNYTEFQKP

SEQ ID NO: 69970 - protein, 21 aa, Homo sapiens
KLQAPLNYTEFQKPICLPSKG

SEQ ID NO: 69971 - protein, 10 aa, Homo sapiens
LAFSDVDVAR

SEQ ID NO: 69972 - protein, 13 aa, Homo sapiens
LCNTGDNSVCTTK

SEQ ID NO: 69973 - protein, 8 aa, Homo sapiens
LNLSDITK

SEQ ID NO: 69974 - protein, 11 aa, Homo sapiens
LPASSINDMEK

SEQ ID NO: 69975 - protein, 12 aa, Homo sapiens
LQAPLNYTEFQK

SEQ ID NO: 69976 - protein, 19 aa, Homo sapiens
LQAPLNYTEFQKPICLPSK

SEQ ID NO: 69977 - protein, 9 aa, Homo sapiens
LSMDGSPTR

SEQ ID NO: 69978 - protein, 11 aa, Homo sapiens
LTQLYENAFFR

SEQ ID NO: 69979 - protein, 13 aa, Homo sapiens
LVGITSWGEGCAR

SEQ ID NO: 69980 - protein, 8 aa, Homo sapiens
LYENAFFR

SEQ ID NO: 69981 - protein, 7 aa, Homo sapiens
MVCAGYK

SEQ ID NO: 69982 - protein, 15 aa, Homo sapiens
NIFQHLAFSDVDVAR

SEQ ID NO: 69983 - protein, 16 aa, Homo sapiens
PGVDFGGEELNVTFVK

SEQ ID NO: 69984 - protein, 16 aa, Homo sapiens
PLNYTEFQKPICLPSK

SEQ ID NO: 69985 - protein, 9 aa, Homo sapiens
PWQVSLQVK

SEQ ID NO: 69986 - protein, 12 aa, Homo sapiens
QHLAFSDVDVAR

SEQ ID NO: 69987 - protein, 9 aa, Homo sapiens
REQPGVYTK

SEQ ID NO: 69988 - protein, 10 aa, Homo sapiens
RGVNFNVSKV

SEQ ID NO: 69989 - protein, 23 aa, Homo sapiens
RIVGGTNSSWGEWPWQVSLQVKL

SEQ ID NO: 69990 - protein, 15 aa, Homo sapiens
RIYSGILNLSDITKD

SEQ ID NO: 69991 - protein, 11 aa, Homo sapiens
SEGNHDIALIK

SEQ ID NO: 69992 - protein, 13 aa, Homo sapiens
SFLPASSINDMEK

SEQ ID NO: 69993 - protein, 19 aa, Homo sapiens
SGILNLSDITKDTPFSQIK

SEQ ID NO: 69994 - protein, 9 aa, Homo sapiens
SYATQTFHK

SEQ ID NO: 69995 - protein, 8 aa, Homo sapiens
TFYTNVWK

SEQ ID NO: 69996 - protein, 10 aa, Homo sapiens
TGAVSGHSLK

SEQ ID NO: 69997 - protein, 20 aa, Homo sapiens
TICTYHPNCLFFTFYTNVWK

SEQ ID NO: 69998 - protein, 20 aa, Homo sapiens
TSESGTPSSSTPQENTISGY

SEQ ID NO: 69999 - protein, 23 aa, Homo sapiens
TSESGTPSSSTPQENTISGYSLL

SEQ ID NO: 70000 - protein, 26 aa, Homo sapiens
TSESGTPSSSTPQENTISGYSLLTCK

SEQ ID NO: 70001 - protein, 27 aa, Homo sapiens
TSESGTPSSSTPQENTISGYSLLTCKR

SEQ ID NO: 70002 - protein, 11 aa, Homo sapiens
VAEYMDWILEK

SEQ ID NO: 70003 - protein, 12 aa, Homo sapiens
VLSNVESGFSLK

SEQ ID NO: 70004 - protein, 10 aa, Homo sapiens
VLTPDAFVCR

SEQ ID NO: 70005 - protein, 13 aa, Homo sapiens
VNIPLVTNEECQK

SEQ ID NO: 70006 - protein, 14 aa, Homo sapiens
VNIPLVTNEECQKR

SEQ ID NO: 70007 - protein, 12 aa, Homo sapiens
VSEGNHDIALIK

SEQ ID NO: 70008 - protein, 9 aa, Homo sapiens
YQDYKITQR

SEQ ID NO: 70009 - protein, 11 aa, Homo sapiens
YSPGGTPTAIK

SEQ ID NO: 70010 - protein, 11 aa, Homo sapiens
ATAQMLEVMFK

SEQ ID NO: 70011 - protein, 13 aa, Homo sapiens
DFLFLGANVQYMR

SEQ ID NO: 70012 - protein, 17 aa, Homo sapiens
GISISVNLLLGSESSGR

SEQ ID NO: 70013 - protein, 19 aa, Homo sapiens
GLQYAAQEGLLALQSELLR

SEQ ID NO: 70014 - protein, 22 aa, Homo sapiens
HSALRPVPGQGLSLSISDSSIR

SEQ ID NO: 70015 - protein, 23 aa, Homo sapiens
ITDKGLQYAAQEGLLALQSELLR

SEQ ID NO: 70016 - protein, 9 aa, Homo sapiens
ITGFLKPGK

SEQ ID NO: 70017 - protein, 11 aa, Homo sapiens
ITLPDFTGDLR

SEQ ID NO: 70018 - protein, 11 aa, Homo sapiens
LAEGFPLPLLK

SEQ ID NO: 70019 - protein, 10 aa, Homo sapiens
LQGSFDVSVK

SEQ ID NO: 70020 - protein, 25 aa, Homo sapiens
LQTLPVTTEIDSFADIDYSLVEAPR

SEQ ID NO: 70021 - protein, 17 aa, Homo sapiens
PVPGQGLSLSISDSSIR

SEQ ID NO: 70022 - protein, 13 aa, Homo sapiens
RVQLYDLGLQIHK

SEQ ID NO: 70023 - protein, 21 aa, Homo sapiens
SALRPVPGQGLSLSISDSSIR

SEQ ID NO: 70024 - protein, 8 aa, Homo sapiens
SFRPFVPR

SEQ ID NO: 70025 - protein, 14 aa, Homo sapiens
SITDDMIPPDSNIR

SEQ ID NO: 70026 - protein, 18 aa, Homo sapiens
SPVTLLAAVMSLPEEHNK

SEQ ID NO: 70027 - protein, 34 aa, Homo sapiens
SVSSDLQPYLQTLPVTTEIDSFADIDYSLVEAPR

SEQ ID NO: 70028 - protein, 12 aa, Homo sapiens
VQLYDLGLQIHK

SEQ ID NO: 70029 - protein, 14 aa, Homo sapiens
QDFLKVVVETFANK

SEQ ID NO: 70030 - protein, 10 aa, Homo sapiens
RWEYCNLTRC

SEQ ID NO: 70031 - protein, 9 aa, Homo sapiens
AGLEKNYCR

SEQ ID NO: 70032 - protein, 19 aa, Homo sapiens
ATTVTGTPCQEWAAQEPHR

SEQ ID NO: 70033 - protein, 11 aa, Homo sapiens
CQSWSSMTPHR

SEQ ID NO: 70034 - protein, 13 aa, Homo sapiens
DCMFGNGKGYRGK

SEQ ID NO: 70035 - protein, 11 aa, Homo sapiens
DKYILQGVTSW

SEQ ID NO: 70036 - protein, 17 aa, Homo sapiens
DKYILQGVTSWGLGCAR

SEQ ID NO: 70037 - protein, 16 aa, Homo sapiens
EAQLLVIENEVCNHYK

SEQ ID NO: 70038 - protein, 11 aa, Homo sapiens
EVVLLLLLFLK

SEQ ID NO: 70039 - protein, 10 aa, Homo sapiens
FVTWIEGMMR

SEQ ID NO: 70040 - protein, 17 aa, Homo sapiens
GGCVAHPHSWPWQVSLR

SEQ ID NO: 70041 - protein, 10 aa, Homo sapiens
GISSTTVTGR

SEQ ID NO: 70042 - protein, 10 aa, Homo sapiens
GSFSTTVTGR

SEQ ID NO: 70043 - protein, 18 aa, Homo sapiens
GTDSCQGDSGGPLVCFEK

SEQ ID NO: 70044 - protein, 10 aa, Homo sapiens
GTLSTTITGR

SEQ ID NO: 70045 - protein, 10 aa, Homo sapiens
GTYSTTVTGR

SEQ ID NO: 70046 - protein, 21 aa, Homo sapiens
HFCGGTLISPEWVLTAAHCLK

SEQ ID NO: 70047 - protein, 10 aa, Homo sapiens
HSTFIPGTNK

SEQ ID NO: 70048 - protein, 14 aa, Homo sapiens
LFLEPTQADIALLK

SEQ ID NO: 70049 - protein, 18 aa, Homo sapiens
NPDAEIRPWCYTMDPSVR

SEQ ID NO: 70050 - protein, 13 aa, Homo sapiens
NPDAVAAPYCYTR

SEQ ID NO: 70051 - protein, 18 aa, Homo sapiens
NPDPVAAPWCYTTDPSVR

SEQ ID NO: 70052 - protein, 10 aa, Homo sapiens
SSMTPHSHSR

SEQ ID NO: 70053 - protein, 15 aa, Homo sapiens
TCQAWSSMTPHSHSR

SEQ ID NO: 70054 - protein, 15 aa, Homo sapiens
TCQSWSSMTPHWHQR

SEQ ID NO: 70055 - protein, 12 aa, Homo sapiens
TPAYYPNAGLIK

SEQ ID NO: 70056 - protein, 16 aa, Homo sapiens
TPENYPNAGLTENYCR

SEQ ID NO: 70057 - protein, 12 aa, Homo sapiens
TPENYPNAGLTR

SEQ ID NO: 70058 - protein, 16 aa, Homo sapiens
TPENYPNAGLTRNYCR

SEQ ID NO: 70059 - protein, 14 aa, Homo sapiens
TPEYYPNAGLIMNY

SEQ ID NO: 70060 - protein, 16 aa, Homo sapiens
TPEYYPNAGLIMNYCR

SEQ ID NO: 70061 - protein, 12 aa, Homo sapiens
TTEYYPNGGLTR

SEQ ID NO: 70062 - protein, 14 aa, Homo sapiens
VAHPHSWPWQVSLR

SEQ ID NO: 70063 - protein, 10 aa, Homo sapiens
VILGAHQEVN

SEQ ID NO: 70064 - protein, 22 aa, Homo sapiens
VILGAHQEVNLESHVQEIEVSR

SEQ ID NO: 70065 - protein, 32 aa, Homo sapiens
VLATSTAVSEQAPTEQSPTVQDCYHGDGQSYR

SEQ ID NO: 70066 - protein, 16 aa, Homo sapiens
VMPACLPSPDYMVTAR

SEQ ID NO: 70067 - protein, 8 aa, Homo sapiens
VQEIEVSR

SEQ ID NO: 70068 - protein, 8 aa, Homo sapiens
WEYCNLTR

SEQ ID NO: 70069 - protein, 9 aa, Homo sapiens
YICAEHLAR

SEQ ID NO: 70070 - protein, 15 aa, Homo sapiens
YILQGVTSWGLGCAR

SEQ ID NO: 70071 - protein, 11 aa, Homo sapiens
ALGHLDLSGNR

SEQ ID NO: 70072 - protein, 13 aa, Homo sapiens
ALGHLDLSGNRLR

SEQ ID NO: 70073 - protein, 7 aa, Homo sapiens
ANFTLLR

SEQ ID NO: 70074 - protein, 8 aa, Homo sapiens
CAGPEAVK

SEQ ID NO: 70075 - protein, 17 aa, Homo sapiens
CAGPEAVKGQTLLAVAK

SEQ ID NO: 70076 - protein, 6 aa, Homo sapiens
DCQVFR

SEQ ID NO: 70077 - protein, 21 aa, Homo sapiens
DGFDISGNPWICDQNLSDLYR

SEQ ID NO: 70078 - protein, 10 aa, Homo sapiens
DKMFSQNDTR

SEQ ID NO: 70079 - protein, 18 aa, Homo sapiens
DKMFSQNDTRCAGPEAVK

SEQ ID NO: 70080 - protein, 10 aa, Homo sapiens
DLLLPQPDLR

SEQ ID NO: 70081 - protein, 24 aa, Homo sapiens
ELHLSSNGLESLSPEFLRPVPQLR

SEQ ID NO: 70082 - protein, 16 aa, Homo sapiens
ENQLEVLEVSWLHGLK

SEQ ID NO: 70083 - protein, 17 aa, Homo sapiens
FNLTHLPANLLQGASKL

SEQ ID NO: 70084 - protein, 9 aa, Homo sapiens
GHLDLSGNR

SEQ ID NO: 70085 - protein, 7 aa, Homo sapiens
GPLQLER

SEQ ID NO: 70086 - protein, 14 aa, Homo sapiens
GPLQLERLHLEGNK

SEQ ID NO: 70087 - protein, 20 aa, Homo sapiens
GPLQLERLHLEGNKLQVLGK

SEQ ID NO: 70088 - protein, 30 aa, Homo sapiens
GPLQLERLHLEGNKLQVLGKDLLLPQPDLR

SEQ ID NO: 70089 - protein, 9 aa, Homo sapiens
GQTLLAVAK

SEQ ID NO: 70090 - protein, 14 aa, Homo sapiens
KLPPGLLANFTLLR

SEQ ID NO: 70091 - protein, 15 aa, Homo sapiens
KLPPGLLANFTLLRT

SEQ ID NO: 70092 - protein, 17 aa, Homo sapiens
KLQVLGKDLLLPQPDLR

SEQ ID NO: 70093 - protein, 10 aa, Homo sapiens
KMFSQNDTRC

SEQ ID NO: 70094 - protein, 8 aa, Homo sapiens
LANFTLLR

SEQ ID NO: 70095 - protein, 21 aa, Homo sapiens
LAVEFFNLTHLPANLLQGASK

SEQ ID NO: 70096 - protein, 7 aa, Homo sapiens
LHLEGNK

SEQ ID NO: 70097 - protein, 13 aa, Homo sapiens
LHLEGNKLQVLGK

SEQ ID NO: 70098 - protein, 23 aa, Homo sapiens
LHLEGNKLQVLGKDLLLPQPDLR

SEQ ID NO: 70099 - protein, 34 aa, Homo sapiens
LHLEGNKLQVLGKDLLLPQPDLRYLFLNGNKLAR

SEQ ID NO: 70100 - protein, 13 aa, Homo sapiens
LPPGLLANFTLLR

SEQ ID NO: 70101 - protein, 20 aa, Homo sapiens
LQELHLSSNGLESLSPEFLR

SEQ ID NO: 70102 - protein, 24 aa, Homo sapiens
LQELHLSSNGLESLSPEFLRPVPQ

SEQ ID NO: 70103 - protein, 26 aa, Homo sapiens
LQELHLSSNGLESLSPEFLRPVPQLR

SEQ ID NO: 70104 - protein, 6 aa, Homo sapiens
LQVLGK

SEQ ID NO: 70105 - protein, 16 aa, Homo sapiens
LRKLPPGLLANFTLLR

SEQ ID NO: 70106 - protein, 8 aa, Homo sapiens
MFSQNDTR

SEQ ID NO: 70107 - protein, 16 aa, Homo sapiens
MFSQNDTRCAGPEAVK

SEQ ID NO: 70108 - protein, 23 aa, Homo sapiens
NALTGLPPGLFQASATLDTLVLK

SEQ ID NO: 70109 - protein, 27 aa, Homo sapiens
PADTVHLAVEFFNLTHLPANLLQGASK

SEQ ID NO: 70110 - protein, 16 aa, Homo sapiens
PEGLWASLGQPNWDMR

SEQ ID NO: 70111 - protein, 31 aa, Homo sapiens
PGYLPADTVHLAVEFFNLTHLPANLLQGASK

SEQ ID NO: 70112 - protein, 17 aa, Homo sapiens
PPGLFQASATLDTLVLK

SEQ ID NO: 70113 - protein, 12 aa, Homo sapiens
PPGLLANFTLLR

SEQ ID NO: 70114 - protein, 25 aa, Homo sapiens
QELHLSSNGLESLSPEFLRPVPQLR

SEQ ID NO: 70115 - protein, 31 aa, Homo sapiens
QLDMLDLSNNSLASVPEGLWASLGQPNWDMR

SEQ ID NO: 70116 - protein, 15 aa, Homo sapiens
QRPKSPGGIQPHVSR

SEQ ID NO: 70117 - protein, 23 aa, Homo sapiens
RDGFDISGNPWICDQNLSDLYRW

SEQ ID NO: 70118 - protein, 33 aa, Homo sapiens
RQLDMLDLSNNSLASVPEGLWASLGQPNWDMRD

SEQ ID NO: 70119 - protein, 21 aa, Homo sapiens
SLASVPEGLWASLGQPNWDMR

SEQ ID NO: 70120 - protein, 18 aa, Homo sapiens
TLDLGENQLETLPPDLLR

SEQ ID NO: 70121 - protein, 25 aa, Homo sapiens
TLDLGENQLETLPPDLLRGPLQLER

SEQ ID NO: 70122 - protein, 10 aa, Homo sapiens
VAAGAFQGLR

SEQ ID NO: 70123 - protein, 6 aa, Homo sapiens
VLDLTR

SEQ ID NO: 70124 - protein, 6 aa, Homo sapiens
WLQAQK

SEQ ID NO: 70125 - protein, 8 aa, Homo sapiens
WLQAQKDK

SEQ ID NO: 70126 - protein, 16 aa, Homo sapiens
WLQAQKDKMFSQNDTR

SEQ ID NO: 70127 - protein, 8 aa, Homo sapiens
YLFLNGNK

SEQ ID NO: 70128 - protein, 11 aa, Homo sapiens
YLFLNGNKLAR

SEQ ID NO: 70129 - protein, 14 aa, Homo sapiens
HFVGYPTNSDFELK

SEQ ID NO: 70130 - protein, 10 aa, Homo sapiens
LGFDVVFNYK

SEQ ID NO: 70131 - protein, 14 aa, Homo sapiens
LKEGDTMMGQQVAK

SEQ ID NO: 70132 - protein, 19 aa, Homo sapiens
TGPLPPGPPPEIVIYQELR

SEQ ID NO: 70133 - protein, 11 aa, Homo sapiens
TVESLEETLKK

SEQ ID NO: 70134 - protein, 10 aa, Homo sapiens
VVGAVGSDEK

SEQ ID NO: 70135 - protein, 7 aa, Homo sapiens
AGYVLHR

SEQ ID NO: 70136 - protein, 19 aa, Homo sapiens
APGKDTFYSLGSSLDITFR

SEQ ID NO: 70137 - protein, 15 aa, Homo sapiens
DTFYSLGSSLDITFR

SEQ ID NO: 70138 - protein, 16 aa, Homo sapiens
GDSGGALVFLDSETER

SEQ ID NO: 70139 - protein, 9 aa, Homo sapiens
HDASALDIR

SEQ ID NO: 70140 - protein, 16 aa, Homo sapiens
LASPGFPGEYANDQER

SEQ ID NO: 70141 - protein, 17 aa, Homo sapiens
LASPGFPGEYANDQERR

SEQ ID NO: 70142 - protein, 14 aa, Homo sapiens
NLMYVDIPIVDHQK

SEQ ID NO: 70143 - protein, 10 aa, Homo sapiens
PGEYANDQER

SEQ ID NO: 70144 - protein, 13 aa, Homo sapiens
PGFPGEYANDQER

SEQ ID NO: 70145 - protein, 15 aa, Homo sapiens
SDYSNEKPFTGFEAF

SEQ ID NO: 70146 - protein, 14 aa, Homo sapiens
SLPVCEPVCGLSAR

SEQ ID NO: 70147 - protein, 10 aa, Homo sapiens
TGGRIYGGQK

SEQ ID NO: 70148 - protein, 14 aa, Homo sapiens
TPLGPKWPEPVFGR

SEQ ID NO: 70149 - protein, 11 aa, Homo sapiens
TTGGRIYGGQK

SEQ ID NO: 70150 - protein, 13 aa, Homo sapiens
VEYITGPGVTTYK

SEQ ID NO: 70151 - protein, 15 aa, Homo sapiens
VLATLCGQESTDTER

SEQ ID NO: 70152 - protein, 8 aa, Homo sapiens
WPEPVFGR

SEQ ID NO: 70153 - protein, 10 aa, Homo sapiens
WTLTAPPGYR

SEQ ID NO: 70154 - protein, 21 aa, Homo sapiens
ICDQISDAVLDAHLKQDPNAK

SEQ ID NO: 70155 - protein, 20 aa, Homo sapiens
IIVDTYGGWGAHGGGAFSGK

SEQ ID NO: 70156 - protein, 22 aa, Homo sapiens
KIKNMNSTLTFVTLSGELRARR

SEQ ID NO: 70157 - protein, 8 aa, Homo sapiens
AAFCYQIR

SEQ ID NO: 70158 - protein, 24 aa, Homo sapiens
AFHYNVSSHGCQLLPWTQHSPHTR

SEQ ID NO: 70159 - protein, 19 aa, Homo sapiens
CTDDVRPQDCYHGAGEQYR

SEQ ID NO: 70160 - protein, 13 aa, Homo sapiens
EAACVWCNGEEYR

SEQ ID NO: 70161 - protein, 12 aa, Homo sapiens
FLDQGLDDNYCR

SEQ ID NO: 70162 - protein, 19 aa, Homo sapiens
GEGYRGTANTTTAGVPCQR

SEQ ID NO: 70163 - protein, 14 aa, Homo sapiens
GGHPGNSPWTVSLR

SEQ ID NO: 70164 - protein, 21 aa, Homo sapiens
GKGEGYRGTANTTTAGVPCQR

SEQ ID NO: 70165 - protein, 14 aa, Homo sapiens
GTANTTTAGVPCQR

SEQ ID NO: 70166 - protein, 29 aa, Homo sapiens
GTELQHLLHAVVPGPWQEDVADAEECAGR

SEQ ID NO: 70167 - protein, 24 aa, Homo sapiens
GTGNDTVLNVALLNVISNQECNIK

SEQ ID NO: 70168 - protein, 26 aa, Homo sapiens
KGTGNDTVLNVALLNVISNQECNIKH

SEQ ID NO: 70169 - protein, 14 aa, Homo sapiens
MVCGPSGSQLVLLK

SEQ ID NO: 70170 - protein, 17 aa, Homo sapiens
MVCGPSGSQLVLLKLER

SEQ ID NO: 70171 - protein, 9 aa, Homo sapiens
NGLEENFCR

SEQ ID NO: 70172 - protein, 19 aa, Homo sapiens
NPDGDPGGPWCYTTDPAVR

SEQ ID NO: 70173 - protein, 17 aa, Homo sapiens
NPDGDSHGPWCYTMDPR

SEQ ID NO: 70174 - protein, 14 aa, Homo sapiens
NPDGSEAPWCFTLR

SEQ ID NO: 70175 - protein, 9 aa, Homo sapiens
PPDQVQFEK

SEQ ID NO: 70176 - protein, 10 aa, Homo sapiens
PWTQHSPHTR

SEQ ID NO: 70177 - protein, 26 aa, Homo sapiens
RAFHYNVSSHGCQLLPWTQHSPHTRL

SEQ ID NO: 70178 - protein, 16 aa, Homo sapiens
RGTANTTTAGVPCQRW

SEQ ID NO: 70179 - protein, 10 aa, Homo sapiens
SPLNDFQVLR

SEQ ID NO: 70180 - protein, 11 aa, Homo sapiens
TCIMNNGVGYR

SEQ ID NO: 70181 - protein, 9 aa, Homo sapiens
TPFDYCALR

SEQ ID NO: 70182 - protein, 18 aa, Homo sapiens
VALICLPPEWYVVPPGTK

SEQ ID NO: 70183 - protein, 10 aa, Homo sapiens
VLEGIIIPNR

SEQ ID NO: 70184 - protein, 10 aa, Homo sapiens
VSVFVDWIHK

SEQ ID NO: 70185 - protein, 11 aa, Homo sapiens
VVGGHPGNSPW

SEQ ID NO: 70186 - protein, 16 aa, Homo sapiens
VVGGHPGNSPWTVSLR

SEQ ID NO: 70187 - protein, 10 aa, Homo sapiens
WDAQIPHQHR

SEQ ID NO: 70188 - protein, 15 aa, Homo sapiens
WDLQHPHQHPFEPGK

SEQ ID NO: 70189 - protein, 34 aa, Homo sapiens
MPTFCIPENHCGTHAPVWLNGSHPLEGDGIVQRQ

SEQ ID NO: 70190 - protein, 22 aa, Homo sapiens
ADKPETTKEQLGEFYEALDCLR

SEQ ID NO: 70191 - protein, 23 aa, Homo sapiens
AFDVNDEKNWGLSVYADKPETTK

SEQ ID NO: 70192 - protein, 19 aa, Homo sapiens
ANLVPVPITNATLDQITGK

SEQ ID NO: 70193 - protein, 20 aa, Homo sapiens
CANLVPVPITNATLDQITGK

SEQ ID NO: 70194 - protein, 12 aa, Homo sapiens
CIYNTTYLNVQR

SEQ ID NO: 70195 - protein, 30 aa, Homo sapiens
DTKTYMLAFDVNDEKNWGLSVYADKPETTK

SEQ ID NO: 70196 - protein, 21 aa, Homo sapiens
DVNDEKNWGLSVYADKPETTK

SEQ ID NO: 70197 - protein, 17 aa, Homo sapiens
EKNWGLSVYADKPETTK

SEQ ID NO: 70198 - protein, 14 aa, Homo sapiens
EQLGEFYEALDCLR

SEQ ID NO: 70199 - protein, 17 aa, Homo sapiens
EQLGEFYEALDCLRIPK

SEQ ID NO: 70200 - protein, 20 aa, Homo sapiens
EYQTRQDQCIYNTTYLNVQR

SEQ ID NO: 70201 - protein, 27 aa, Homo sapiens
EYQTRQDQCIYNTTYLNVQRENGTISR

SEQ ID NO: 70202 - protein, 8 aa, Homo sapiens
FAHLLILR

SEQ ID NO: 70203 - protein, 9 aa, Homo sapiens
FYEALDCLR

SEQ ID NO: 70204 - protein, 11 aa, Homo sapiens
GEFYEALDCLR

SEQ ID NO: 70205 - protein, 13 aa, Homo sapiens
GGQEHFAHLLILR

SEQ ID NO: 70206 - protein, 16 aa, Homo sapiens
GGQEHFAHLLILRDTK

SEQ ID NO: 70207 - protein, 13 aa, Homo sapiens
GLSVYADKPETTK

SEQ ID NO: 70208 - protein, 12 aa, Homo sapiens
GQEHFAHLLILR

SEQ ID NO: 70209 - protein, 15 aa, Homo sapiens
GQEHFAHLLILRDTK

SEQ ID NO: 70210 - protein, 9 aa, Homo sapiens
HFAHLLILR

SEQ ID NO: 70211 - protein, 6 aa, Homo sapiens
HLLILR

SEQ ID NO: 70212 - protein, 12 aa, Homo sapiens
IPKSDVVYTDWK

SEQ ID NO: 70213 - protein, 13 aa, Homo sapiens
IPKSDVVYTDWKK

SEQ ID NO: 70214 - protein, 15 aa, Homo sapiens
IPKSDVVYTDWKKDK

SEQ ID NO: 70215 - protein, 21 aa, Homo sapiens
IPKSDVVYTDWKKDKCEPLEK

SEQ ID NO: 70216 - protein, 25 aa, Homo sapiens
IPKSDVVYTDWKKDKCEPLEKQHEK

SEQ ID NO: 70217 - protein, 27 aa, Homo sapiens
IPKSDVVYTDWKKDKCEPLEKQHEKER

SEQ ID NO: 70218 - protein, 23 aa, Homo sapiens
IPLCANLVPVPITNATLDQITGK

SEQ ID NO: 70219 - protein, 11 aa, Homo sapiens
IYNTTYLNVQR

SEQ ID NO: 70220 - protein, 24 aa, Homo sapiens
LAFDVNDEKNWGLSVYADKPETTK

SEQ ID NO: 70221 - protein, 12 aa, Homo sapiens
LSVYADKPETTK

SEQ ID NO: 70222 - protein, 17 aa, Homo sapiens
LVPVPITNATLDQITGK

SEQ ID NO: 70223 - protein, 10 aa, Homo sapiens
MLAFDVNDEK

SEQ ID NO: 70224 - protein, 25 aa, Homo sapiens
MLAFDVNDEKNWGLSVYADKPETTK

SEQ ID NO: 70225 - protein, 19 aa, Homo sapiens
NDEKNWGLSVYADKPETTK

SEQ ID NO: 70226 - protein, 18 aa, Homo sapiens
NLVPVPITNATLDQITGK

SEQ ID NO: 70227 - protein, 12 aa, Homo sapiens
NVQRENGTISRY

SEQ ID NO: 70228 - protein, 10 aa, Homo sapiens
NWGLSVYADK

SEQ ID NO: 70229 - protein, 15 aa, Homo sapiens
NWGLSVYADKPETTK

SEQ ID NO: 70230 - protein, 29 aa, Homo sapiens
NWGLSVYADKPETTKEQLGEFYEALDCLR

SEQ ID NO: 70231 - protein, 13 aa, Homo sapiens
PITNATLDQITGK

SEQ ID NO: 70232 - protein, 12 aa, Homo sapiens
PKSDVVYTDWKK

SEQ ID NO: 70233 - protein, 14 aa, Homo sapiens
PKSDVVYTDWKKDK

SEQ ID NO: 70234 - protein, 15 aa, Homo sapiens
PVPITNATLDQITGK

SEQ ID NO: 70235 - protein, 13 aa, Homo sapiens
QCIYNTTYLNVQR

SEQ ID NO: 70236 - protein, 15 aa, Homo sapiens
QDQCIYNTTYLNVQR

SEQ ID NO: 70237 - protein, 17 aa, Homo sapiens
QDQCIYNTTYLNVQREN

SEQ ID NO: 70238 - protein, 22 aa, Homo sapiens
QDQCIYNTTYLNVQRENGTISR

SEQ ID NO: 70239 - protein, 24 aa, Homo sapiens
QIPLCANLVPVPITNATLDQITGK

SEQ ID NO: 70240 - protein, 9 aa, Homo sapiens
RENGTISRY

SEQ ID NO: 70241 - protein, 17 aa, Homo sapiens
RQDQCIYNTTYLNVQRE

SEQ ID NO: 70242 - protein, 9 aa, Homo sapiens
SDVVYTDWK

SEQ ID NO: 70243 - protein, 10 aa, Homo sapiens
SDVVYTDWKK

SEQ ID NO: 70244 - protein, 12 aa, Homo sapiens
SDVVYTDWKKDK

SEQ ID NO: 70245 - protein, 18 aa, Homo sapiens
SDVVYTDWKKDKCEPLEK

SEQ ID NO: 70246 - protein, 22 aa, Homo sapiens
SDVVYTDWKKDKCEPLEKQHEK

SEQ ID NO: 70247 - protein, 31 aa, Homo sapiens
SDVVYTDWKKDKCEPLEKQHEKERKQEEGES

SEQ ID NO: 70248 - protein, 11 aa, Homo sapiens
SVYADKPETTK

SEQ ID NO: 70249 - protein, 19 aa, Homo sapiens
TISRYVGGQEHFAHLLILR

SEQ ID NO: 70250 - protein, 11 aa, Homo sapiens
TNATLDQITGK

SEQ ID NO: 70251 - protein, 12 aa, Homo sapiens
TNATLDQITGKW

SEQ ID NO: 70252 - protein, 17 aa, Homo sapiens
TTKEQLGEFYEALDCLR

SEQ ID NO: 70253 - protein, 8 aa, Homo sapiens
TTYLNVQR

SEQ ID NO: 70254 - protein, 7 aa, Homo sapiens
TYLNVQR

SEQ ID NO: 70255 - protein, 12 aa, Homo sapiens
TYMLAFDVNDEK

SEQ ID NO: 70256 - protein, 27 aa, Homo sapiens
TYMLAFDVNDEKNWGLSVYADKPETTK

SEQ ID NO: 70257 - protein, 14 aa, Homo sapiens
VGGQEHFAHLLILR

SEQ ID NO: 70258 - protein, 17 aa, Homo sapiens
VGGQEHFAHLLILRDTK

SEQ ID NO: 70259 - protein, 16 aa, Homo sapiens
VPVPITNATLDQITGK

SEQ ID NO: 70260 - protein, 17 aa, Homo sapiens
VPVPITNATLDQITGKW

SEQ ID NO: 70261 - protein, 15 aa, Homo sapiens
VYTDWKKDKCEPLEK

SEQ ID NO: 70262 - protein, 14 aa, Homo sapiens
WGLSVYADKPETTK

SEQ ID NO: 70263 - protein, 10 aa, Homo sapiens
YVGGQEHFAH

SEQ ID NO: 70264 - protein, 11 aa, Homo sapiens
YVGGQEHFAHL

SEQ ID NO: 70265 - protein, 12 aa, Homo sapiens
YVGGQEHFAHLL

SEQ ID NO: 70266 - protein, 15 aa, Homo sapiens
YVGGQEHFAHLLILR

SEQ ID NO: 70267 - protein, 16 aa, Homo sapiens
YVGGQEHFAHLLILRD

SEQ ID NO: 70268 - protein, 18 aa, Homo sapiens
YVGGQEHFAHLLILRDTK

SEQ ID NO: 70269 - protein, 20 aa, Homo sapiens
YVGGQEHFAHLLILRDTKTY

SEQ ID NO: 70270 - protein, 21 aa, Homo sapiens
AAPWETGDTFPDVVAIAPDVR

SEQ ID NO: 70271 - protein, 18 aa, Homo sapiens
AFLNGALDGVILGDYLSR

SEQ ID NO: 70272 - protein, 14 aa, Homo sapiens
AGLLRPDYALLGHR

SEQ ID NO: 70273 - protein, 18 aa, Homo sapiens
AGLLRPDYALLGHRQLVR

SEQ ID NO: 70274 - protein, 17 aa, Homo sapiens
AIVGNYTAALPTEAALR

SEQ ID NO: 70275 - protein, 26 aa, Homo sapiens
AKSPPTMVDSLLAVTLAGNLGLTFLR

SEQ ID NO: 70276 - protein, 24 aa, Homo sapiens
ASLLTMAFLNGALDGVILGDYLSR

SEQ ID NO: 70277 - protein, 16 aa, Homo sapiens
CMSQEQLAQVAANATK

SEQ ID NO: 70278 - protein, 14 aa, Homo sapiens
DGSPDVTTADIGAN

SEQ ID NO: 70279 - protein, 20 aa, Homo sapiens
DGSPDVTTADIGANTPDATK

SEQ ID NO: 70280 - protein, 9 aa, Homo sapiens
DTLPSCAVR

SEQ ID NO: 70281 - protein, 15 aa, Homo sapiens
EFTEAFLGCPAIHPR

SEQ ID NO: 70282 - protein, 32 aa, Homo sapiens
EGKEYGVVLAPDGSTVAVEPLLAGLEAGLQGR

SEQ ID NO: 70283 - protein, 29 aa, Homo sapiens
EYGVVLAPDGSTVAVEPLLAGLEAGLQGR

SEQ ID NO: 70284 - protein, 17 aa, Homo sapiens
FLNGALDGVILGDYLSR

SEQ ID NO: 70285 - protein, 13 aa, Homo sapiens
GCPDVQASLPDAK

SEQ ID NO: 70286 - protein, 21 aa, Homo sapiens
GFGVAIVGNYTAALPTEAALR

SEQ ID NO: 70287 - protein, 13 aa, Homo sapiens
GLLRPDYALLGHR

SEQ ID NO: 70288 - protein, 19 aa, Homo sapiens
GSPDVTTADIGANTPDATK

SEQ ID NO: 70289 - protein, 23 aa, Homo sapiens
GSQTQSHPDLGTEGCWDQLSAPR

SEQ ID NO: 70290 - protein, 8 aa, Homo sapiens
GWHWVGAH

SEQ ID NO: 70291 - protein, 12 aa, Homo sapiens
GWHWVGAHTLGH

SEQ ID NO: 70292 - protein, 15 aa, Homo sapiens
GWHWVGAHTLGHNSR

SEQ ID NO: 70293 - protein, 36 aa, Homo sapiens
HDVREGKEYGVVLAPDGSTVAVEPLLAGLEAGLQGR

SEQ ID NO: 70294 - protein, 18 aa, Homo sapiens
HTASAWLMSAPNSGPHNR

SEQ ID NO: 70295 - protein, 16 aa, Homo sapiens
IVGNYTAALPTEAALR

SEQ ID NO: 70296 - protein, 11 aa, Homo sapiens
LAGLEAGLQGR

SEQ ID NO: 70297 - protein, 9 aa, Homo sapiens
LEPVHLQLQ

SEQ ID NO: 70298 - protein, 10 aa, Homo sapiens
LEPVHLQLQC

SEQ ID NO: 70299 - protein, 25 aa, Homo sapiens
LEPVHLQLQCMSQEQLAQVAANATK

SEQ ID NO: 70300 - protein, 8 aa, Homo sapiens
LLQLPLGF

SEQ ID NO: 70301 - protein, 10 aa, Homo sapiens
LLQLPLGFLY

SEQ ID NO: 70302 - protein, 12 aa, Homo sapiens
LLQLPLGFLYVH

SEQ ID NO: 70303 - protein, 13 aa, Homo sapiens
LLQLPLGFLYVHH

SEQ ID NO: 70304 - protein, 26 aa, Homo sapiens
LLQLPLGFLYVHHTYVPAPPCTDFTR

SEQ ID NO: 70305 - protein, 12 aa, Homo sapiens
LLSQYYGAGVAR

SEQ ID NO: 70306 - protein, 16 aa, Homo sapiens
LNGALDGVILGDYLSR

SEQ ID NO: 70307 - protein, 18 aa, Homo sapiens
LPLLMDSVIQALAELEQK

SEQ ID NO: 70308 - protein, 23 aa, Homo sapiens
LPLLMDSVIQALAELEQKVPAAK

SEQ ID NO: 70309 - protein, 17 aa, Homo sapiens
LYHFLLGAWSLNATELD

SEQ ID NO: 70310 - protein, 30 aa, Homo sapiens
LYHFLLGAWSLNATELDPCPLSPELLGLTK

SEQ ID NO: 70311 - protein, 22 aa, Homo sapiens
PDGSTVAVEPLLAGLEAGLQGR

SEQ ID NO: 70312 - protein, 11 aa, Homo sapiens
PDVQASLPDAK

SEQ ID NO: 70313 - protein, 17 aa, Homo sapiens
PDVTTADIGANTPDATK

SEQ ID NO: 70314 - protein, 9 aa, Homo sapiens
PDYALLGHR

SEQ ID NO: 70315 - protein, 17 aa, Homo sapiens
PLLMDSVIQALAELEQK

SEQ ID NO: 70316 - protein, 17 aa, Homo sapiens
PSLSHLLSQYYGAGVAR

SEQ ID NO: 70317 - protein, 17 aa, Homo sapiens
QCMSQEQLAQVAANATK

SEQ ID NO: 70318 - protein, 25 aa, Homo sapiens
QNGAALTSASILAQQVWGTLVLLQR

SEQ ID NO: 70319 - protein, 11 aa, Homo sapiens
QVWGTLVLLQR

SEQ ID NO: 70320 - protein, 23 aa, Homo sapiens
RGFGVAIVGNYTAALPTEAALRT

SEQ ID NO: 70321 - protein, 27 aa, Homo sapiens
RLEPVHLQLQCMSQEQLAQVAANATKE

SEQ ID NO: 70322 - protein, 32 aa, Homo sapiens
RLYHFLLGAWSLNATELDPCPLSPELLGLTKE

SEQ ID NO: 70323 - protein, 26 aa, Homo sapiens
RQNGAALTSASILAQQVWGTLVLLQR

SEQ ID NO: 70324 - protein, 31 aa, Homo sapiens
RVINLPLDSMAAPWETGDTFPDVVAIAPDVR

SEQ ID NO: 70325 - protein, 21 aa, Homo sapiens
SLNATELDPCPLSPELLGLTK

SEQ ID NO: 70326 - protein, 19 aa, Homo sapiens
SLPLLMDSVIQALAELEQK

SEQ ID NO: 70327 - protein, 18 aa, Homo sapiens
SPDVTTADIGANTPDATK

SEQ ID NO: 70328 - protein, 24 aa, Homo sapiens
SPPTMVDSLLAVTLAGNLGLTFLR

SEQ ID NO: 70329 - protein, 19 aa, Homo sapiens
STVAVEPLLAGLEAGLQGR

SEQ ID NO: 70330 - protein, 13 aa, Homo sapiens
TDCPGDALFDLLR

SEQ ID NO: 70331 - protein, 8 aa, Homo sapiens
TFTLLDPK

SEQ ID NO: 70332 - protein, 22 aa, Homo sapiens
TPEPRPSLSHLLSQYYGAGVAR

SEQ ID NO: 70333 - protein, 18 aa, Homo sapiens
TRHTASAWLMSAPNSGPH

SEQ ID NO: 70334 - protein, 19 aa, Homo sapiens
TSASILAQQVWGTLVLLQR

SEQ ID NO: 70335 - protein, 12 aa, Homo sapiens
TVRDTLPSCAVR

SEQ ID NO: 70336 - protein, 15 aa, Homo sapiens
VGNYTAALPTEAALR

SEQ ID NO: 70337 - protein, 16 aa, Homo sapiens
VHHTYVPAPPCTDFTR

SEQ ID NO: 70338 - protein, 9 aa, Homo sapiens
VINLPLDSM

SEQ ID NO: 70339 - protein, 30 aa, Homo sapiens
VINLPLDSMAAPWETGDTFPDVVAIAPDVR

SEQ ID NO: 70340 - protein, 12 aa, Homo sapiens
VVGSDGYVYEGR

SEQ ID NO: 70341 - protein, 7 aa, Homo sapiens
WGAAPYR

SEQ ID NO: 70342 - protein, 13 aa, Homo sapiens
YHQDTQGWGDIGY

SEQ ID NO: 70343 - protein, 12 aa, Homo sapiens
YTAALPTEAALR

SEQ ID NO: 70344 - protein, 13 aa, Homo sapiens
AFNCPPNSTMNRG

SEQ ID NO: 70345 - protein, 25 aa, Homo sapiens
AETSDVANAVLDGADCIMLSGETAK

SEQ ID NO: 70346 - protein, 34 aa, Homo sapiens
KAGMNIARLNFSHGSHEYHAESIANVREAVESFA

SEQ ID NO: 70347 - protein, 7 aa, Homo sapiens
AFQYHSK

SEQ ID NO: 70348 - protein, 18 aa, Homo sapiens
AFQYHSKEQQCVIMAENR

SEQ ID NO: 70349 - protein, 19 aa, Homo sapiens
AFQYHSKEQQCVIMAENRK

SEQ ID NO: 70350 - protein, 26 aa, Homo sapiens
AGLEKNYCRNPDGDVGGPWCYTTNPR

SEQ ID NO: 70351 - protein, 8 aa, Homo sapiens
AHGYIPSK

SEQ ID NO: 70352 - protein, 25 aa, Homo sapiens
APPPVVLLPDVETPSEEDCMFGNGK

SEQ ID NO: 70353 - protein, 12 aa, Homo sapiens
APWCHTTNSQVR

SEQ ID NO: 70354 - protein, 11 aa, Homo sapiens
ARPNKPGVYVR

SEQ ID NO: 70355 - protein, 19 aa, Homo sapiens
ATTVTGTPCQDWAAQEPHR

SEQ ID NO: 70356 - protein, 30 aa, Homo sapiens
ATTVTGTPCQDWAAQEPHRHSIFTPETNPR

SEQ ID NO: 70357 - protein, 10 aa, Homo sapiens
CEEDEEFTCR

SEQ ID NO: 70358 - protein, 34 aa, Homo sapiens
CSGTEASVVAPPPVVLLPDVETPSEEDCMFGNGK

SEQ ID NO: 70359 - protein, 16 aa, Homo sapiens
CTTPPPSSGPTYQCLK

SEQ ID NO: 70360 - protein, 16 aa, Homo sapiens
DIALLKLSSPAVITDK

SEQ ID NO: 70361 - protein, 7 aa, Homo sapiens
DVVLFEK

SEQ ID NO: 70362 - protein, 10 aa, Homo sapiens
EAQLPVIENK

SEQ ID NO: 70363 - protein, 6 aa, Homo sapiens
EECAAK

SEQ ID NO: 70364 - protein, 13 aa, Homo sapiens
ELRPWCFTTDPNK

SEQ ID NO: 70365 - protein, 14 aa, Homo sapiens
ELRPWCFTTDPNKR

SEQ ID NO: 70366 - protein, 19 aa, Homo sapiens
EPLDDYVNTQGASLFSVTK

SEQ ID NO: 70367 - protein, 20 aa, Homo sapiens
EPLDDYVNTQGASLFSVTKK

SEQ ID NO: 70368 - protein, 11 aa, Homo sapiens
EQQCVIMAENR

SEQ ID NO: 70369 - protein, 12 aa, Homo sapiens
EQQCVIMAENRK

SEQ ID NO: 70370 - protein, 21 aa, Homo sapiens
FGMHFCGGTLISPEWVLTAAH

SEQ ID NO: 70371 - protein, 25 aa, Homo sapiens
FGMHFCGGTLISPEWVLTAAHCLEK

SEQ ID NO: 70372 - protein, 14 aa, Homo sapiens
FSPATHPSEGLEEN

SEQ ID NO: 70373 - protein, 17 aa, Homo sapiens
FSPATHPSEGLEENYCR

SEQ ID NO: 70374 - protein, 10 aa, Homo sapiens
FVTWIEGVMR

SEQ ID NO: 70375 - protein, 12 aa, Homo sapiens
FVTWIEGVMRNN

SEQ ID NO: 70376 - protein, 19 aa, Homo sapiens
GAHQEVNLEPHVQEIEVSR

SEQ ID NO: 70377 - protein, 22 aa, Homo sapiens
GKRATTVTGTPCQDWAAQEPHR

SEQ ID NO: 70378 - protein, 10 aa, Homo sapiens
GNVAVTVSGH

SEQ ID NO: 70379 - protein, 21 aa, Homo sapiens
GNVAVTVSGHTCQHWSAQTPH

SEQ ID NO: 70380 - protein, 25 aa, Homo sapiens
GNVAVTVSGHTCQHWSAQTPHTHNR

SEQ ID NO: 70381 - protein, 12 aa, Homo sapiens
GPWCFTTDPSVR

SEQ ID NO: 70382 - protein, 7 aa, Homo sapiens
GTGENYR

SEQ ID NO: 70383 - protein, 19 aa, Homo sapiens
HQKTPENYPNAGLTMNYCR

SEQ ID NO: 70384 - protein, 11 aa, Homo sapiens
HSIFTPETNPR

SEQ ID NO: 70385 - protein, 16 aa, Homo sapiens
HSIFTPETNPRAGLEK

SEQ ID NO: 70386 - protein, 21 aa, Homo sapiens
ILGAHQEVNLEPHVQEIEVSR

SEQ ID NO: 70387 - protein, 17 aa, Homo sapiens
ITGWGETQGTFGAGLLK

SEQ ID NO: 70388 - protein, 12 aa, Homo sapiens
KCQSWSSMTPHR

SEQ ID NO: 70389 - protein, 20 aa, Homo sapiens
KLYDYCDVPQCAAPSFDCGK

SEQ ID NO: 70390 - protein, 26 aa, Homo sapiens
KLYDYCDVPQCAAPSFDCGKPQVEPK

SEQ ID NO: 70391 - protein, 14 aa, Homo sapiens
KQLGAGSIEECAAK

SEQ ID NO: 70392 - protein, 8 aa, Homo sapiens
KVYLSECK

SEQ ID NO: 70393 - protein, 13 aa, Homo sapiens
KVYLSECKTGNGK

SEQ ID NO: 70394 - protein, 16 aa, Homo sapiens
KVYLSECKTGNGKNYR

SEQ ID NO: 70395 - protein, 17 aa, Homo sapiens
LDDYVNTQGASLFSVTK

SEQ ID NO: 70396 - protein, 7 aa, Homo sapiens
LFLEPTR

SEQ ID NO: 70397 - protein, 8 aa, Homo sapiens
LFLEPTRK

SEQ ID NO: 70398 - protein, 14 aa, Homo sapiens
LFLEPTRKDIALLK

SEQ ID NO: 70399 - protein, 20 aa, Homo sapiens
LGAHQEVNLEPHVQEIEVSR

SEQ ID NO: 70400 - protein, 10 aa, Homo sapiens
LSSPAVITDK

SEQ ID NO: 70401 - protein, 19 aa, Homo sapiens
LYDYCDVPQCAAPSFDCGK

SEQ ID NO: 70402 - protein, 25 aa, Homo sapiens
LYDYCDVPQCAAPSFDCGKPQVEPK

SEQ ID NO: 70403 - protein, 9 aa, Homo sapiens
MRDVVLFEK

SEQ ID NO: 70404 - protein, 10 aa, Homo sapiens
MRDVVLFEKK

SEQ ID NO: 70405 - protein, 17 aa, Homo sapiens
NGITCQKWSSTSPHRPR

SEQ ID NO: 70406 - protein, 8 aa, Homo sapiens
NLDENYCR

SEQ ID NO: 70407 - protein, 13 aa, Homo sapiens
NLDENYCRNPDGK

SEQ ID NO: 70408 - protein, 11 aa, Homo sapiens
NPDADKGPWCF

SEQ ID NO: 70409 - protein, 14 aa, Homo sapiens
NPDADKGPWCFTTD

SEQ ID NO: 70410 - protein, 18 aa, Homo sapiens
NPDADKGPWCFTTDPSVR

SEQ ID NO: 70411 - protein, 17 aa, Homo sapiens
NPDGDVGGPWCYTTNPR

SEQ ID NO: 70412 - protein, 18 aa, Homo sapiens
NPDNDPQGPWCYTTDPEK

SEQ ID NO: 70413 - protein, 19 aa, Homo sapiens
NPDNDPQGPWCYTTDPEKR

SEQ ID NO: 70414 - protein, 21 aa, Homo sapiens
NYCRNPDGDVGGPWCYTTNPR

SEQ ID NO: 70415 - protein, 12 aa, Homo sapiens
PCQDWAAQEPHR

SEQ ID NO: 70416 - protein, 23 aa, Homo sapiens
PCQDWAAQEPHRHSIFTPETNPR

SEQ ID NO: 70417 - protein, 10 aa, Homo sapiens
PHVQEIEVSR

SEQ ID NO: 70418 - protein, 9 aa, Homo sapiens
PNKPGVYVR

SEQ ID NO: 70419 - protein, 13 aa, Homo sapiens
PPPSSGPTYQCLK

SEQ ID NO: 70420 - protein, 24 aa, Homo sapiens
PPPVVLLPDVETPSEEDCMFGNGK

SEQ ID NO: 70421 - protein, 14 aa, Homo sapiens
PQGPWCYTTDPEKR

SEQ ID NO: 70422 - protein, 11 aa, Homo sapiens
PWCHTTNSQVR

SEQ ID NO: 70423 - protein, 13 aa, Homo sapiens
QLGAGSIEECAAK

SEQ ID NO: 70424 - protein, 23 aa, Homo sapiens
QLGAGSIEECAAKCEEDEEFTCR

SEQ ID NO: 70425 - protein, 13 aa, Homo sapiens
RAPWCHTTNSQVR

SEQ ID NO: 70426 - protein, 20 aa, Homo sapiens
RATTVTGTPCQDWAAQEPHR

SEQ ID NO: 70427 - protein, 31 aa, Homo sapiens
RATTVTGTPCQDWAAQEPHRHSIFTPETNPR

SEQ ID NO: 70428 - protein, 27 aa, Homo sapiens
RGNVAVTVSGHTCQHWSAQTPHTHNRT

SEQ ID NO: 70429 - protein, 9 aa, Homo sapiens
RWELCDIPR

SEQ ID NO: 70430 - protein, 22 aa, Homo sapiens
SGLECQAWDSQSPHAHGYIPSK

SEQ ID NO: 70431 - protein, 10 aa, Homo sapiens
SIFTPETNPR

SEQ ID NO: 70432 - protein, 8 aa, Homo sapiens
SPAVITDK

SEQ ID NO: 70433 - protein, 8 aa, Homo sapiens
SPRPSSYK

SEQ ID NO: 70434 - protein, 6 aa, Homo sapiens
SSIIIR

SEQ ID NO: 70435 - protein, 15 aa, Homo sapiens
TCQHWSAQTPHTHNR

SEQ ID NO: 70436 - protein, 21 aa, Homo sapiens
TECFITGWGETQGTFGAGLLK

SEQ ID NO: 70437 - protein, 15 aa, Homo sapiens
TGTPCQDWAAQEPHR

SEQ ID NO: 70438 - protein, 16 aa, Homo sapiens
TGWGETQGTFGAGLLK

SEQ ID NO: 70439 - protein, 13 aa, Homo sapiens
THPSEGLEENYCR

SEQ ID NO: 70440 - protein, 9 aa, Homo sapiens
TKNGITCQK

SEQ ID NO: 70441 - protein, 17 aa, Homo sapiens
TLISPEWVLTAAHCLEK

SEQ ID NO: 70442 - protein, 19 aa, Homo sapiens
TMSGLECQAWDSQSPHAHG

SEQ ID NO: 70443 - protein, 24 aa, Homo sapiens
TMSGLECQAWDSQSPHAHGYIPSK

SEQ ID NO: 70444 - protein, 28 aa, Homo sapiens
TMSGLECQAWDSQSPHAHGYIPSKFPNK

SEQ ID NO: 70445 - protein, 31 aa, Homo sapiens
TMSGLECQAWDSQSPHAHGYIPSKFPNKNLK

SEQ ID NO: 70446 - protein, 13 aa, Homo sapiens
TPCQDWAAQEPHR

SEQ ID NO: 70447 - protein, 8 aa, Homo sapiens
TPENFPCK

SEQ ID NO: 70448 - protein, 13 aa, Homo sapiens
TPENYPNAGLTMN

SEQ ID NO: 70449 - protein, 16 aa, Homo sapiens
TPENYPNAGLTMNYCR

SEQ ID NO: 70450 - protein, 11 aa, Homo sapiens
VCNRYEFLNGR

SEQ ID NO: 70451 - protein, 14 aa, Homo sapiens
VILGAHQEVNLEPH

SEQ ID NO: 70452 - protein, 16 aa, Homo sapiens
VILGAHQEVNLEPHVQ

SEQ ID NO: 70453 - protein, 22 aa, Homo sapiens
VILGAHQEVNLEPHVQEIEVSR

SEQ ID NO: 70454 - protein, 16 aa, Homo sapiens
VIPACLPSPNYVVADR

SEQ ID NO: 70455 - protein, 37 aa, Homo sapiens
VIPACLPSPNYVVADRTECFITGWGETQGTFGAGLLK

SEQ ID NO: 70456 - protein, 31 aa, Homo sapiens
VQSTELCAGHLAGGTDSCQGDSGGPLVCFEK

SEQ ID NO: 70457 - protein, 19 aa, Homo sapiens
VVGGCVAHPHSWPWQVSLR

SEQ ID NO: 70458 - protein, 7 aa, Homo sapiens
VYLSECK

SEQ ID NO: 70459 - protein, 15 aa, Homo sapiens
VYLSECKTGNGKNYR

SEQ ID NO: 70460 - protein, 20 aa, Homo sapiens
VYLSECKTGNGKNYRGTMSK

SEQ ID NO: 70461 - protein, 10 aa, Homo sapiens
WCHTTNSQVR

SEQ ID NO: 70462 - protein, 15 aa, Homo sapiens
WDSQSPHAHGYIPSK

SEQ ID NO: 70463 - protein, 8 aa, Homo sapiens
WELCDIPR

SEQ ID NO: 70464 - protein, 8 aa, Homo sapiens
WEYCNLKK

SEQ ID NO: 70465 - protein, 8 aa, Homo sapiens
WSSTSPHR

SEQ ID NO: 70466 - protein, 10 aa, Homo sapiens
WSSTSPHRPR

SEQ ID NO: 70467 - protein, 16 aa, Homo sapiens
YDYCDILECEEECMHC

SEQ ID NO: 70468 - protein, 24 aa, Homo sapiens
YDYCDILECEEECMHCSGENYDGK

SEQ ID NO: 70469 - protein, 7 aa, Homo sapiens
YEFLNGR

SEQ ID NO: 70470 - protein, 10 aa, Homo sapiens
CEEDKEFTCR

SEQ ID NO: 70471 - protein, 17 aa, Homo sapiens
LDDYVNTQGPSLFSVTK

SEQ ID NO: 70472 - protein, 17 aa, Homo sapiens
AENGTVLQGSTVASVYK

SEQ ID NO: 70473 - protein, 17 aa, Homo sapiens
AKLIALTLLGMGLALFR

SEQ ID NO: 70474 - protein, 26 aa, Homo sapiens
AKLIALTLLGMGLALFRNHQSSYQTR

SEQ ID NO: 70475 - protein, 18 aa, Homo sapiens
DLNEEDPTVLELGITGSK

SEQ ID NO: 70476 - protein, 14 aa, Homo sapiens
EVQPVELPNCNLVK

SEQ ID NO: 70477 - protein, 9 aa, Homo sapiens
FDVSSFNPH

SEQ ID NO: 70478 - protein, 32 aa, Homo sapiens
FDVSSFNPHGISTFTDEDNAMYLLVVNHPDAK

SEQ ID NO: 70479 - protein, 12 aa, Homo sapiens
FQEEEKSLLHLK

SEQ ID NO: 70480 - protein, 14 aa, Homo sapiens
FYDSENPPASEVLR

SEQ ID NO: 70481 - protein, 14 aa, Homo sapiens
GIETGSEDLEILPN

SEQ ID NO: 70482 - protein, 18 aa, Homo sapiens
GIETGSEDLEILPNGLAF

SEQ ID NO: 70483 - protein, 24 aa, Homo sapiens
GIETGSEDLEILPNGLAFISSGLK

SEQ ID NO: 70484 - protein, 29 aa, Homo sapiens
GIETGSEDLEILPNGLAFISSGLKYPGIK

SEQ ID NO: 70485 - protein, 23 aa, Homo sapiens
GISTFTDEDNAMYLLVVNHPDAK

SEQ ID NO: 70486 - protein, 11 aa, Homo sapiens
GKLLIGTVFHK

SEQ ID NO: 70487 - protein, 10 aa, Homo sapiens
GLAFISSGLK

SEQ ID NO: 70488 - protein, 14 aa, Homo sapiens
GTVLQGSTVASVYK

SEQ ID NO: 70489 - protein, 10 aa, Homo sapiens
HANWTLTPLK

SEQ ID NO: 70490 - protein, 8 aa, Homo sapiens
IAELLAHK

SEQ ID NO: 70491 - protein, 16 aa, Homo sapiens
IFFYDSENPPASEVLR

SEQ ID NO: 70492 - protein, 6 aa, Homo sapiens
IHVYEK

SEQ ID NO: 70493 - protein, 16 aa, Homo sapiens
IHVYEKHANWTLTPLK

SEQ ID NO: 70494 - protein, 22 aa, Homo sapiens
ILLMDLNEEDPTVLELGITGSK

SEQ ID NO: 70495 - protein, 10 aa, Homo sapiens
IQNILTEEPK

SEQ ID NO: 70496 - protein, 32 aa, Homo sapiens
IQNILTEEPKVTQVYAENGTVLQGSTVASVYK

SEQ ID NO: 70497 - protein, 12 aa, Homo sapiens
KHANWTLTPLKS

SEQ ID NO: 70498 - protein, 24 aa, Homo sapiens
KVTQVYAENGTVLQGSTVASVYKG

SEQ ID NO: 70499 - protein, 15 aa, Homo sapiens
LIALTLLGMGLALFR

SEQ ID NO: 70500 - protein, 9 aa, Homo sapiens
LLIGTVFHK

SEQ ID NO: 70501 - protein, 15 aa, Homo sapiens
LLPNLNDIVAVGPEH

SEQ ID NO: 70502 - protein, 16 aa, Homo sapiens
LLPNLNDIVAVGPEHF

SEQ ID NO: 70503 - protein, 17 aa, Homo sapiens
LLPNLNDIVAVGPEHFY

SEQ ID NO: 70504 - protein, 20 aa, Homo sapiens
LLPNLNDIVAVGPEHFYGTN

SEQ ID NO: 70505 - protein, 10 aa, Homo sapiens
LLVVNHPDAK

SEQ ID NO: 70506 - protein, 19 aa, Homo sapiens
LNALREVQPVELPNCNLVK

SEQ ID NO: 70507 - protein, 9 aa, Homo sapiens
LVVNHPDAK

SEQ ID NO: 70508 - protein, 15 aa, Homo sapiens
NGTVLQGSTVASVYK

SEQ ID NO: 70509 - protein, 9 aa, Homo sapiens
NHQSSYQTR

SEQ ID NO: 70510 - protein, 19 aa, Homo sapiens
NPHGISTFTDEDNAMYLLV

SEQ ID NO: 70511 - protein, 12 aa, Homo sapiens
PNGLAFISSGLK

SEQ ID NO: 70512 - protein, 8 aa, Homo sapiens
PPASEVLR

SEQ ID NO: 70513 - protein, 12 aa, Homo sapiens
PTVLELGITGSK

SEQ ID NO: 70514 - protein, 20 aa, Homo sapiens
QVYAENGTVLQGSTVASVYK

SEQ ID NO: 70515 - protein, 21 aa, Homo sapiens
RVVAEGFDFANGINISPDGKY

SEQ ID NO: 70516 - protein, 9 aa, Homo sapiens
SFNPNSPGK

SEQ ID NO: 70517 - protein, 28 aa, Homo sapiens
SLDFNTLVDNISVDPETGDLWVGCHPNG

SEQ ID NO: 70518 - protein, 30 aa, Homo sapiens
SLDFNTLVDNISVDPETGDLWVGCHPNGMK

SEQ ID NO: 70519 - protein, 7 aa, Homo sapiens
STVELFK

SEQ ID NO: 70520 - protein, 13 aa, Homo sapiens
STVELFKFQEEEK

SEQ ID NO: 70521 - protein, 19 aa, Homo sapiens
STVELFKFQEEEKSLLHLK

SEQ ID NO: 70522 - protein, 19 aa, Homo sapiens
SVDPETGDLWVGCHPNGMK

SEQ ID NO: 70523 - protein, 12 aa, Homo sapiens
SYVVYYSPSEVR

SEQ ID NO: 70524 - protein, 23 aa, Homo sapiens
VDNISVDPETGDLWVGCHPNGMK

SEQ ID NO: 70525 - protein, 22 aa, Homo sapiens
VTQVYAENGTVLQGSTVASVYK

SEQ ID NO: 70526 - protein, 24 aa, Homo sapiens
VTQVYAENGTVLQGSTVASVYKGK

SEQ ID NO: 70527 - protein, 19 aa, Homo sapiens
VVAEGFDFANGINISPDGK

SEQ ID NO: 70528 - protein, 30 aa, Homo sapiens
VVAEGFDFANGINISPDGKYVYIAELLAHK

SEQ ID NO: 70529 - protein, 10 aa, Homo sapiens
VVYYSPSEVR

SEQ ID NO: 70530 - protein, 9 aa, Homo sapiens
YIAELLAHK

SEQ ID NO: 70531 - protein, 11 aa, Homo sapiens
YLLVVNHPDAK

SEQ ID NO: 70532 - protein, 11 aa, Homo sapiens
YVVYYSPSEVR

SEQ ID NO: 70533 - protein, 10 aa, Homo sapiens
YVYIAELLAH

SEQ ID NO: 70534 - protein, 11 aa, Homo sapiens
YVYIAELLAHK

SEQ ID NO: 70535 - protein, 17 aa, Homo sapiens
YVYIAELLAHKIHVYEK

SEQ ID NO: 70536 - protein, 12 aa, Homo sapiens
AQALEISGGFDK

SEQ ID NO: 70537 - protein, 14 aa, Homo sapiens
ELFNPHGISIFIDK

SEQ ID NO: 70538 - protein, 15 aa, Homo sapiens
GFCSANGITVSADQK

SEQ ID NO: 70539 - protein, 10 aa, Homo sapiens
HDNWDLTQLK

SEQ ID NO: 70540 - protein, 9 aa, Homo sapiens
ILIGTVFHK

SEQ ID NO: 70541 - protein, 10 aa, Homo sapiens
IQNVLSEKPR

SEQ ID NO: 70542 - protein, 16 aa, Homo sapiens
LLNYNPEDPPGSEVLR

SEQ ID NO: 70543 - protein, 26 aa, Homo sapiens
RVSTVYANNGSVLQGTSVASVYHGKI

SEQ ID NO: 70544 - protein, 7 aa, Homo sapiens
STVEIFK

SEQ ID NO: 70545 - protein, 17 aa, Homo sapiens
SVNDIVVLGPEQFYATR

SEQ ID NO: 70546 - protein, 30 aa, Homo sapiens
VIQLGTLVDNLTVDPATGDILAGCHPNPMK

SEQ ID NO: 70547 - protein, 24 aa, Homo sapiens
VSTVYANNGSVLQGTSVASVYHGK

SEQ ID NO: 70548 - protein, 14 aa, Homo sapiens
YPGMPNFAPDEPGK

SEQ ID NO: 70549 - protein, 10 aa, Homo sapiens
YVYVADVAAK

SEQ ID NO: 70550 - protein, 22 aa, Homo sapiens
RVVSNSSVLASQSVGITNVRTV

SEQ ID NO: 70551 - protein, 12 aa, Homo sapiens
APDLQDLPWQVK

SEQ ID NO: 70552 - protein, 10 aa, Homo sapiens
DFAEHLLIPR

SEQ ID NO: 70553 - protein, 9 aa, Homo sapiens
DFCGGVIIR

SEQ ID NO: 70554 - protein, 19 aa, Homo sapiens
GSWFLTGVLGSQPVGGQAH

SEQ ID NO: 70555 - protein, 7 aa, Homo sapiens
ITHVHVH

SEQ ID NO: 70556 - protein, 9 aa, Homo sapiens
ITHVHVHMR

SEQ ID NO: 70557 - protein, 17 aa, Homo sapiens
QCVPHDQCACGVLTSEK

SEQ ID NO: 70558 - protein, 13 aa, Homo sapiens
RAPDLQDLPWQVK

SEQ ID NO: 70559 - protein, 16 aa, Homo sapiens
SSVAAMHWMDGSVVTR

SEQ ID NO: 70560 - protein, 24 aa, Homo sapiens
TDGCQHFCLPGQESYTCSCAQGYR

SEQ ID NO: 70561 - protein, 33 aa, Homo sapiens
YDADAGENDLSLLELEWPIQCPGAGLPVCTPEK

SEQ ID NO: 70562 - protein, 6 aa, Homo sapiens
YSLWFK

SEQ ID NO: 70563 - protein, 21 aa, Homo sapiens
RVGAHDPPAQVLQELNVTVVT

SEQ ID NO: 70564 - protein, 15 aa, Homo sapiens
ADMVGTFTDTEDPAK

SEQ ID NO: 70565 - protein, 10 aa, Homo sapiens
ADSYSFVFSR

SEQ ID NO: 70566 - protein, 21 aa, Homo sapiens
ADSYSFVFSRDPNGLPPEAQK

SEQ ID NO: 70567 - protein, 28 aa, Homo sapiens
DPEGLFLQDNIVAEFSVDETGQMSATAK

SEQ ID NO: 70568 - protein, 11 aa, Homo sapiens
DPNGLPPEAQK

SEQ ID NO: 70569 - protein, 10 aa, Homo sapiens
FSGTWYAMAK

SEQ ID NO: 70570 - protein, 11 aa, Homo sapiens
FSGTWYAMAKK

SEQ ID NO: 70571 - protein, 15 aa, Homo sapiens
GNDDHWIVDTDYDTY

SEQ ID NO: 70572 - protein, 18 aa, Homo sapiens
GNDDHWIVDTDYDTYAVQ

SEQ ID NO: 70573 - protein, 19 aa, Homo sapiens
GNDDHWIVDTDYDTYAVQY

SEQ ID NO: 70574 - protein, 20 aa, Homo sapiens
GNDDHWIVDTDYDTYAVQYS

SEQ ID NO: 70575 - protein, 22 aa, Homo sapiens
GNDDHWIVDTDYDTYAVQYSCR

SEQ ID NO: 70576 - protein, 16 aa, Homo sapiens
KDPEGLFLQDNIVAEF

SEQ ID NO: 70577 - protein, 24 aa, Homo sapiens
KDPEGLFLQDNIVAEFSVDETGQM

SEQ ID NO: 70578 - protein, 27 aa, Homo sapiens
KDPEGLFLQDNIVAEFSVDETGQMSAT

SEQ ID NO: 70579 - protein, 29 aa, Homo sapiens
KDPEGLFLQDNIVAEFSVDETGQMSATAK

SEQ ID NO: 70580 - protein, 11 aa, Homo sapiens
LIVHNGYCDGR

SEQ ID NO: 70581 - protein, 18 aa, Homo sapiens
LLNLDGTCADSYSFVFSR

SEQ ID NO: 70582 - protein, 23 aa, Homo sapiens
LLNNWDVCADMVGTFTDTEDPAK

SEQ ID NO: 70583 - protein, 12 aa, Homo sapiens
MKYWGVASFLQK

SEQ ID NO: 70584 - protein, 13 aa, Homo sapiens
MVGTFTDTEDPAK

SEQ ID NO: 70585 - protein, 10 aa, Homo sapiens
PNGLPPEAQK

SEQ ID NO: 70586 - protein, 13 aa, Homo sapiens
PNGLPPEAQKIVR

SEQ ID NO: 70587 - protein, 8 aa, Homo sapiens
QEELCLAR

SEQ ID NO: 70588 - protein, 10 aa, Homo sapiens
QRQEELCLAR

SEQ ID NO: 70589 - protein, 12 aa, Homo sapiens
TCADSYSFVFSR

SEQ ID NO: 70590 - protein, 7 aa, Homo sapiens
VKENFDK

SEQ ID NO: 70591 - protein, 9 aa, Homo sapiens
VKENFDKAR

SEQ ID NO: 70592 - protein, 14 aa, Homo sapiens
VSSFRVKENFDKAR

SEQ ID NO: 70593 - protein, 9 aa, Homo sapiens
WGVASFLQK

SEQ ID NO: 70594 - protein, 7 aa, Homo sapiens
YWGVASF

SEQ ID NO: 70595 - protein, 10 aa, Homo sapiens
YWGVASFLQK

SEQ ID NO: 70596 - protein, 19 aa, Homo sapiens
SQCGKMANKANTSGDFEKD

SEQ ID NO: 70597 - protein, 13 aa, Homo sapiens
SQSGHMLLNLSRG

SEQ ID NO: 70598 - protein, 10 aa, Homo sapiens
ADQAANKWGR

SEQ ID NO: 70599 - protein, 15 aa, Homo sapiens
GPGGAWAAEVISNAR

SEQ ID NO: 70600 - protein, 20 aa, Homo sapiens
GPGGAWAAEVISNARENIQR

SEQ ID NO: 70601 - protein, 17 aa, Homo sapiens
HGAEDSLADQAANKWGR

SEQ ID NO: 70602 - protein, 23 aa, Homo sapiens
IQRLTGHGAEDSLADQAANKWGR

SEQ ID NO: 70603 - protein, 16 aa, Homo sapiens
LTGHGAEDSLADQAAN

SEQ ID NO: 70604 - protein, 17 aa, Homo sapiens
LTGHGAEDSLADQAANK

SEQ ID NO: 70605 - protein, 20 aa, Homo sapiens
LTGHGAEDSLADQAANKWGR

SEQ ID NO: 70606 - protein, 26 aa, Homo sapiens
RENIQRLTGHGAEDSLADQAANKWGR

SEQ ID NO: 70607 - protein, 16 aa, Homo sapiens
RGPGGAWAAEVISNAR

SEQ ID NO: 70608 - protein, 21 aa, Homo sapiens
RGPGGAWAAEVISNARENIQR

SEQ ID NO: 70609 - protein, 21 aa, Homo sapiens
RLTGHGAEDSLADQAANKWGR

SEQ ID NO: 70610 - protein, 16 aa, Homo sapiens
SGRDPNHFRPAGLPEK

SEQ ID NO: 70611 - protein, 17 aa, Homo sapiens
SGRDPNHFRPAGLPEKY

SEQ ID NO: 70612 - protein, 19 aa, Homo sapiens
TGHGAEDSLADQAANKWGR

SEQ ID NO: 70613 - protein, 11 aa, Homo sapiens
ADLSELSATGR

SEQ ID NO: 70614 - protein, 7 aa, Homo sapiens
AWLMASR

SEQ ID NO: 70615 - protein, 13 aa, Homo sapiens
EEEEDEQEASEEK

SEQ ID NO: 70616 - protein, 8 aa, Homo sapiens
ETFFNLSK

SEQ ID NO: 70617 - protein, 9 aa, Homo sapiens
ETFFNLSKR

SEQ ID NO: 70618 - protein, 11 aa, Homo sapiens
ETSNFGFSLLR

SEQ ID NO: 70619 - protein, 7 aa, Homo sapiens
FASTFDK

SEQ ID NO: 70620 - protein, 20 aa, Homo sapiens
GLHLQALKPTKPGLLPSLFK

SEQ ID NO: 70621 - protein, 15 aa, Homo sapiens
GTEAVAGILSEITAY

SEQ ID NO: 70622 - protein, 16 aa, Homo sapiens
IFSPFADLSELSATGR

SEQ ID NO: 70623 - protein, 10 aa, Homo sapiens
KETFFNLSKR

SEQ ID NO: 70624 - protein, 18 aa, Homo sapiens
KLPYQGNATMLVVLMEKM

SEQ ID NO: 70625 - protein, 10 aa, Homo sapiens
LFDEINPETK

SEQ ID NO: 70626 - protein, 10 aa, Homo sapiens
LILVDYILFK

SEQ ID NO: 70627 - protein, 8 aa, Homo sapiens
LMNHYINK

SEQ ID NO: 70628 - protein, 16 aa, Homo sapiens
LPYQGNATMLVVLMEK

SEQ ID NO: 70629 - protein, 21 aa, Homo sapiens
MGDHLALEDYLTTDLVETWLR

SEQ ID NO: 70630 - protein, 13 aa, Homo sapiens
MLGATGPTETQIK

SEQ ID NO: 70631 - protein, 21 aa, Homo sapiens
NFRCHVLKLPYQGNATMLVVL

SEQ ID NO: 70632 - protein, 16 aa, Homo sapiens
NLELGLTQGSFAFIHK

SEQ ID NO: 70633 - protein, 8 aa, Homo sapiens
NMEVFFPK

SEQ ID NO: 70634 - protein, 8 aa, Homo sapiens
TVIEVDER

SEQ ID NO: 70635 - protein, 19 aa, Homo sapiens
WLTPFDPVFTEVDTFHLDK

SEQ ID NO: 70636 - protein, 8 aa, Homo sapiens
YEMHELLR

SEQ ID NO: 70637 - protein, 12 aa, Homo sapiens
YFDTECVPMNFR

SEQ ID NO: 70638 - protein, 14 aa, Homo sapiens
GNALALLVLPDPGK

SEQ ID NO: 70639 - protein, 12 aa, Homo sapiens
HQLSEPAPAYHR

SEQ ID NO: 70640 - protein, 33 aa, Homo sapiens
LDSIKELYGAFAFSANFTDSVTTGRQINDYLRR

SEQ ID NO: 70641 - protein, 12 aa, Homo sapiens
QVEAALQPQTLR

SEQ ID NO: 70642 - protein, 12 aa, Homo sapiens
SLLHTLALPSPK

SEQ ID NO: 70643 - protein, 16 aa, Homo sapiens
WGQLLLPSLLDLHLPR

SEQ ID NO: 70644 - protein, 10 aa, Homo sapiens
ADLSGITGAR

SEQ ID NO: 70645 - protein, 12 aa, Homo sapiens
AEIHQSFQHLLR

SEQ ID NO: 70646 - protein, 17 aa, Homo sapiens
AFLSLGAHNTTLTEILK

SEQ ID NO: 70647 - protein, 16 aa, Homo sapiens
AKWEMPFDPQDTHQSR

SEQ ID NO: 70648 - protein, 24 aa, Homo sapiens
ALFILPDQDKMEEVEAMLLPETLK

SEQ ID NO: 70649 - protein, 25 aa, Homo sapiens
ALFILPDQDKMEEVEAMLLPETLKR

SEQ ID NO: 70650 - protein, 15 aa, Homo sapiens
APDKNVIFSPLSIST

SEQ ID NO: 70651 - protein, 34 aa, Homo sapiens
APDKNVIFSPLSISTALAFLSLGAHNTTLTEILK

SEQ ID NO: 70652 - protein, 26 aa, Homo sapiens
ASALFILPDQDKMEEVEAMLLPETLK

SEQ ID NO: 70653 - protein, 27 aa, Homo sapiens
ASALFILPDQDKMEEVEAMLLPETLKR

SEQ ID NO: 70654 - protein, 19 aa, Homo sapiens
AVLDVFEEGTEASAATAVK

SEQ ID NO: 70655 - protein, 12 aa, Homo sapiens
DEELSCTVVELK

SEQ ID NO: 70656 - protein, 17 aa, Homo sapiens
DLDSQTMMVLVNYIFFK

SEQ ID NO: 70657 - protein, 6 aa, Homo sapiens
DSLEFR

SEQ ID NO: 70658 - protein, 17 aa, Homo sapiens
DYNLNDILLQLGIEEAF

SEQ ID NO: 70659 - protein, 18 aa, Homo sapiens
DYNLNDILLQLGIEEAFT

SEQ ID NO: 70660 - protein, 20 aa, Homo sapiens
DYNLNDILLQLGIEEAFTSK

SEQ ID NO: 70661 - protein, 13 aa, Homo sapiens
EAEIHQSFQHLLR

SEQ ID NO: 70662 - protein, 9 aa, Homo sapiens
EIGELYLPK

SEQ ID NO: 70663 - protein, 14 aa, Homo sapiens
EIGELYLPKFSISR

SEQ ID NO: 70664 - protein, 8 aa, Homo sapiens
EQLSLLDR

SEQ ID NO: 70665 - protein, 14 aa, Homo sapiens
EQLSLLDRFTEDAK

SEQ ID NO: 70666 - protein, 15 aa, Homo sapiens
EQLSLLDRFTEDAKR

SEQ ID NO: 70667 - protein, 33 aa, Homo sapiens
EQLSLLDRFTEDAKRLYGSEAFATDFQDSAAAK

SEQ ID NO: 70668 - protein, 16 aa, Homo sapiens
ETSEAEIHQSFQHLLR

SEQ ID NO: 70669 - protein, 13 aa, Homo sapiens
FATDFQDSAAAKK

SEQ ID NO: 70670 - protein, 22 aa, Homo sapiens
FILPDQDKMEEVEAMLLPETLK

SEQ ID NO: 70671 - protein, 23 aa, Homo sapiens
FILPDQDKMEEVEAMLLPETLKR

SEQ ID NO: 70672 - protein, 17 aa, Homo sapiens
FNLTETSEAEIHQSFQH

SEQ ID NO: 70673 - protein, 20 aa, Homo sapiens
FNLTETSEAEIHQSFQHLLR

SEQ ID NO: 70674 - protein, 18 aa, Homo sapiens
FNRPFLMIIVPTDTQNIF

SEQ ID NO: 70675 - protein, 22 aa, Homo sapiens
FNRPFLMIIVPTDTQNIFFMSK

SEQ ID NO: 70676 - protein, 14 aa, Homo sapiens
FRDEELSCTVVELK

SEQ ID NO: 70677 - protein, 27 aa, Homo sapiens
FSPLSISTALAFLSLGAHNTTLTEILK

SEQ ID NO: 70678 - protein, 7 aa, Homo sapiens
FTEDAKR

SEQ ID NO: 70679 - protein, 12 aa, Homo sapiens
GAHNTTLTEILK

SEQ ID NO: 70680 - protein, 25 aa, Homo sapiens
GKITDLIKDLDSQTMMVLVNYIFFK

SEQ ID NO: 70681 - protein, 15 aa, Homo sapiens
GLASANVDFAFSLYK

SEQ ID NO: 70682 - protein, 23 aa, Homo sapiens
GLKFNLTETSEAEIHQSFQHLLR

SEQ ID NO: 70683 - protein, 28 aa, Homo sapiens
GNASALFILPDQDKMEEVEAMLLPETLK

SEQ ID NO: 70684 - protein, 29 aa, Homo sapiens
GNASALFILPDQDKMEEVEAMLLPETLKR

SEQ ID NO: 70685 - protein, 17 aa, Homo sapiens
GSEAFATDFQDSAAAKK

SEQ ID NO: 70686 - protein, 12 aa, Homo sapiens
GTHVDLGLASAN

SEQ ID NO: 70687 - protein, 17 aa, Homo sapiens
GTHVDLGLASANVDFAF

SEQ ID NO: 70688 - protein, 21 aa, Homo sapiens
GTHVDLGLASANVDFAFSLYK

SEQ ID NO: 70689 - protein, 18 aa, Homo sapiens
HPNSPLDEENLTQENQDR

SEQ ID NO: 70690 - protein, 9 aa, Homo sapiens
HQSFQHLLR

SEQ ID NO: 70691 - protein, 15 aa, Homo sapiens
IIVPTDTQNIFFMSK

SEQ ID NO: 70692 - protein, 21 aa, Homo sapiens
ILPDQDKMEEVEAMLLPETLK

SEQ ID NO: 70693 - protein, 22 aa, Homo sapiens
ILPDQDKMEEVEAMLLPETLKR

SEQ ID NO: 70694 - protein, 6 aa, Homo sapiens
ITDLIK

SEQ ID NO: 70695 - protein, 23 aa, Homo sapiens
ITDLIKDLDSQTMMVLVNYIFFK

SEQ ID NO: 70696 - protein, 11 aa, Homo sapiens
ITLLSALVETR

SEQ ID NO: 70697 - protein, 22 aa, Homo sapiens
KFNLTETSEAEIHQSFQHLLRT

SEQ ID NO: 70698 - protein, 8 aa, Homo sapiens
KLINDYVK

SEQ ID NO: 70699 - protein, 12 aa, Homo sapiens
KLINDYVKNGTR

SEQ ID NO: 70700 - protein, 13 aa, Homo sapiens
KLINDYVKNGTRG

SEQ ID NO: 70701 - protein, 16 aa, Homo sapiens
KMEEVEAMLLPETLKR

SEQ ID NO: 70702 - protein, 32 aa, Homo sapiens
KNVIFSPLSISTALAFLSLGAHNTTLTEILKG

SEQ ID NO: 70703 - protein, 18 aa, Homo sapiens
KYTGNASALFILPDQDKM

SEQ ID NO: 70704 - protein, 18 aa, Homo sapiens
LAFLSLGAHNTTLTEILK

SEQ ID NO: 70705 - protein, 13 aa, Homo sapiens
LDEENLTQENQDR

SEQ ID NO: 70706 - protein, 17 aa, Homo sapiens
LDVFEEGTEASAATAVK

SEQ ID NO: 70707 - protein, 23 aa, Homo sapiens
LFILPDQDKMEEVEAMLLPETLK

SEQ ID NO: 70708 - protein, 24 aa, Homo sapiens
LFILPDQDKMEEVEAMLLPETLKR

SEQ ID NO: 70709 - protein, 13 aa, Homo sapiens
LGAHNTTLTEILK

SEQ ID NO: 70710 - protein, 7 aa, Homo sapiens
LINDYVK

SEQ ID NO: 70711 - protein, 11 aa, Homo sapiens
LINDYVKNGTR

SEQ ID NO: 70712 - protein, 17 aa, Homo sapiens
LMIIVPTDTQNIFFMSK

SEQ ID NO: 70713 - protein, 20 aa, Homo sapiens
LPDQDKMEEVEAMLLPETLK

SEQ ID NO: 70714 - protein, 21 aa, Homo sapiens
LPDQDKMEEVEAMLLPETLKR

SEQ ID NO: 70715 - protein, 15 aa, Homo sapiens
LSLGAHNTTLTEILK

SEQ ID NO: 70716 - protein, 18 aa, Homo sapiens
LTETSEAEIHQSFQHLLR

SEQ ID NO: 70717 - protein, 18 aa, Homo sapiens
LYGSEAFATDFQDSAAAK

SEQ ID NO: 70718 - protein, 19 aa, Homo sapiens
LYGSEAFATDFQDSAAAKK

SEQ ID NO: 70719 - protein, 13 aa, Homo sapiens
MEEVEAMLLPETL

SEQ ID NO: 70720 - protein, 14 aa, Homo sapiens
MEEVEAMLLPETLK

SEQ ID NO: 70721 - protein, 15 aa, Homo sapiens
MEEVEAMLLPETLKR

SEQ ID NO: 70722 - protein, 12 aa, Homo sapiens
MSLHHLTIPYFR

SEQ ID NO: 70723 - protein, 13 aa, Homo sapiens
NASALFILPDQDK

SEQ ID NO: 70724 - protein, 10 aa, Homo sapiens
NLAVSQVVHK

SEQ ID NO: 70725 - protein, 29 aa, Homo sapiens
NLAVSQVVHKAVLDVFEEGTEASAATAVK

SEQ ID NO: 70726 - protein, 19 aa, Homo sapiens
NLTETSEAEIHQSFQHLLR

SEQ ID NO: 70727 - protein, 16 aa, Homo sapiens
NSPLDEENLTQENQDR

SEQ ID NO: 70728 - protein, 13 aa, Homo sapiens
NVIFSPLSISTAL

SEQ ID NO: 70729 - protein, 15 aa, Homo sapiens
NVIFSPLSISTALAF

SEQ ID NO: 70730 - protein, 30 aa, Homo sapiens
NVIFSPLSISTALAFLSLGAHNTTLTEILK

SEQ ID NO: 70731 - protein, 19 aa, Homo sapiens
PDQDKMEEVEAMLLPETLK

SEQ ID NO: 70732 - protein, 20 aa, Homo sapiens
PDQDKMEEVEAMLLPETLKR

SEQ ID NO: 70733 - protein, 19 aa, Homo sapiens
PFLMIIVPTDTQNIFFMSK

SEQ ID NO: 70734 - protein, 14 aa, Homo sapiens
PLDEENLTQENQDR

SEQ ID NO: 70735 - protein, 17 aa, Homo sapiens
PNSPLDEENLTQENQDR

SEQ ID NO: 70736 - protein, 18 aa, Homo sapiens
PNSPLDEENLTQENQDRG

SEQ ID NO: 70737 - protein, 12 aa, Homo sapiens
PTDTQNIFFMSK

SEQ ID NO: 70738 - protein, 11 aa, Homo sapiens
QLSMGNAMFVK

SEQ ID NO: 70739 - protein, 19 aa, Homo sapiens
RLYGSEAFATDFQDSAAAK

SEQ ID NO: 70740 - protein, 20 aa, Homo sapiens
RLYGSEAFATDFQDSAAAKK

SEQ ID NO: 70741 - protein, 22 aa, Homo sapiens
RTLNQSSDELQLSMGNAMFVKE

SEQ ID NO: 70742 - protein, 25 aa, Homo sapiens
SALFILPDQDKMEEVEAMLLPETLK

SEQ ID NO: 70743 - protein, 26 aa, Homo sapiens
SALFILPDQDKMEEVEAMLLPETLKR

SEQ ID NO: 70744 - protein, 15 aa, Homo sapiens
SDELQLSMGNAMFVK

SEQ ID NO: 70745 - protein, 14 aa, Homo sapiens
SEAEIHQSFQHLLR

SEQ ID NO: 70746 - protein, 15 aa, Homo sapiens
SEAFATDFQDSAAAK

SEQ ID NO: 70747 - protein, 23 aa, Homo sapiens
SISTALAFLSLGAHNTTLTEILK

SEQ ID NO: 70748 - protein, 14 aa, Homo sapiens
SLGAHNTTLTEILK

SEQ ID NO: 70749 - protein, 15 aa, Homo sapiens
SPLDEENLTQENQDR

SEQ ID NO: 70750 - protein, 16 aa, Homo sapiens
SPLDEENLTQENQDRG

SEQ ID NO: 70751 - protein, 16 aa, Homo sapiens
SSDELQLSMGNAMFVK

SEQ ID NO: 70752 - protein, 21 aa, Homo sapiens
STALAFLSLGAHNTTLTEILK

SEQ ID NO: 70753 - protein, 17 aa, Homo sapiens
TETSEAEIHQSFQHLLR

SEQ ID NO: 70754 - protein, 26 aa, Homo sapiens
TIVRFNRPFLMIIVPTDTQNIFFMSK

SEQ ID NO: 70755 - protein, 10 aa, Homo sapiens
TLLSALVETR

SEQ ID NO: 70756 - protein, 20 aa, Homo sapiens
TLNQSSDELQLSMGNAMFVK

SEQ ID NO: 70757 - protein, 12 aa, Homo sapiens
TMMVLVNYIFFK

SEQ ID NO: 70758 - protein, 15 aa, Homo sapiens
TSEAEIHQSFQHLLR

SEQ ID NO: 70759 - protein, 31 aa, Homo sapiens
TTLTEILKGLKFNLTETSEAEIHQSFQHLLR

SEQ ID NO: 70760 - protein, 9 aa, Homo sapiens
VDFAFSLYK

SEQ ID NO: 70761 - protein, 9 aa, Homo sapiens
VLVNYIFFK

SEQ ID NO: 70762 - protein, 14 aa, Homo sapiens
WEMPFDPQDTHQSR

SEQ ID NO: 70763 - protein, 8 aa, Homo sapiens
WRDSLEFR

SEQ ID NO: 70764 - protein, 18 aa, Homo sapiens
WVMVPMMSLHHLTIPYFR

SEQ ID NO: 70765 - protein, 16 aa, Homo sapiens
YTGNASALFILPDQDK

SEQ ID NO: 70766 - protein, 30 aa, Homo sapiens
YTGNASALFILPDQDKMEEVEAMLLPETLK

SEQ ID NO: 70767 - protein, 31 aa, Homo sapiens
YTGNASALFILPDQDKMEEVEAMLLPETLKR

SEQ ID NO: 70768 - protein, 11 aa, Homo sapiens
ALWEKPFISSR

SEQ ID NO: 70769 - protein, 18 aa, Homo sapiens
ATLDVDEAGTEAAAATSF

SEQ ID NO: 70770 - protein, 21 aa, Homo sapiens
ATLDVDEAGTEAAAATSFAIK

SEQ ID NO: 70771 - protein, 11 aa, Homo sapiens
DFYVDENTTVR

SEQ ID NO: 70772 - protein, 25 aa, Homo sapiens
DGESCSNSSHQQILETGEGSPSLKI

SEQ ID NO: 70773 - protein, 14 aa, Homo sapiens
DTVGTIQLINDHVK

SEQ ID NO: 70774 - protein, 13 aa, Homo sapiens
DVLMVLVNYIYFK

SEQ ID NO: 70775 - protein, 17 aa, Homo sapiens
EGLGFNLTELSESDVHR

SEQ ID NO: 70776 - protein, 13 aa, Homo sapiens
EIEEVLTPEMLMR

SEQ ID NO: 70777 - protein, 8 aa, Homo sapiens
FFSAQTNR

SEQ ID NO: 70778 - protein, 16 aa, Homo sapiens
FLAKFLNDTMAVYEAK

SEQ ID NO: 70779 - protein, 12 aa, Homo sapiens
FLNDTMAVYEAK

SEQ ID NO: 70780 - protein, 13 aa, Homo sapiens
FNLTELSESDVHR

SEQ ID NO: 70781 - protein, 22 aa, Homo sapiens
FNRPFLVVIFSTSTQSVLFLGK

SEQ ID NO: 70782 - protein, 15 aa, Homo sapiens
FSISGSYVLDQILPR

SEQ ID NO: 70783 - protein, 16 aa, Homo sapiens
FYDTVGTIQLINDHVK

SEQ ID NO: 70784 - protein, 12 aa, Homo sapiens
FYYLIASETPGK

SEQ ID NO: 70785 - protein, 14 aa, Homo sapiens
GDATVFFILPNQGK

SEQ ID NO: 70786 - protein, 14 aa, Homo sapiens
GFNLTELSESDVHR

SEQ ID NO: 70787 - protein, 19 aa, Homo sapiens
GFQHLLHTLNLPGHGLETR

SEQ ID NO: 70788 - protein, 12 aa, Homo sapiens
GKIVDLVSELKK

SEQ ID NO: 70789 - protein, 16 aa, Homo sapiens
GLGFNLTELSESDVHR

SEQ ID NO: 70790 - protein, 11 aa, Homo sapiens
GSALFLSHNLK

SEQ ID NO: 70791 - protein, 11 aa, Homo sapiens
IAPANADFAFR

SEQ ID NO: 70792 - protein, 19 aa, Homo sapiens
ILEGLGFNLTELSESDVHR

SEQ ID NO: 70793 - protein, 9 aa, Homo sapiens
IVDLVSELK

SEQ ID NO: 70794 - protein, 10 aa, Homo sapiens
IVDLVSELKK

SEQ ID NO: 70795 - protein, 34 aa, Homo sapiens
IVDLVSELKKDVLMVLVNYIYFKALWEKPFISSR

SEQ ID NO: 70796 - protein, 13 aa, Homo sapiens
KDFYVDENTTVRV

SEQ ID NO: 70797 - protein, 14 aa, Homo sapiens
KFLNDTMAVYEAKL

SEQ ID NO: 70798 - protein, 8 aa, Homo sapiens
KLELHLPK

SEQ ID NO: 70799 - protein, 18 aa, Homo sapiens
LEGLGFNLTELSESDVHR

SEQ ID NO: 70800 - protein, 7 aa, Homo sapiens
LELHLPK

SEQ ID NO: 70801 - protein, 21 aa, Homo sapiens
LFHTNFYDTVGTIQLINDHVK

SEQ ID NO: 70802 - protein, 9 aa, Homo sapiens
LGFTDLFSK

SEQ ID NO: 70803 - protein, 18 aa, Homo sapiens
MDYKGDATVFFILPNQGK

SEQ ID NO: 70804 - protein, 14 aa, Homo sapiens
MLQDQEHHWYLHDR

SEQ ID NO: 70805 - protein, 15 aa, Homo sapiens
MREIEEVLTPEMLMR

SEQ ID NO: 70806 - protein, 9 aa, Homo sapiens
PANADFAFR

SEQ ID NO: 70807 - protein, 8 aa, Homo sapiens
PGHGLETR

SEQ ID NO: 70808 - protein, 23 aa, Homo sapiens
RSQILEGLGFNLTELSESDVHRG

SEQ ID NO: 70809 - protein, 21 aa, Homo sapiens
SQILEGLGFNLTELSESDVHR

SEQ ID NO: 70810 - protein, 12 aa, Homo sapiens
TLNLPGHGLETR

SEQ ID NO: 70811 - protein, 15 aa, Homo sapiens
TTPKDFYVDENTTVR

SEQ ID NO: 70812 - protein, 9 aa, Homo sapiens
VGSALFLSH

SEQ ID NO: 70813 - protein, 10 aa, Homo sapiens
VGSALFLSHN

SEQ ID NO: 70814 - protein, 12 aa, Homo sapiens
VGSALFLSHNLK

SEQ ID NO: 70815 - protein, 12 aa, Homo sapiens
VGTIQLINDHVK

SEQ ID NO: 70816 - protein, 17 aa, Homo sapiens
VPMMLQDQEHHWYLHDR

SEQ ID NO: 70817 - protein, 7 aa, Homo sapiens
VVDPTKP

SEQ ID NO: 70818 - protein, 9 aa, Homo sapiens
WADLSGITK

SEQ ID NO: 70819 - protein, 6 aa, Homo sapiens
WNNLLR

SEQ ID NO: 70820 - protein, 17 aa, Homo sapiens
AMDPNAAYVNMSNHHRG

SEQ ID NO: 70821 - protein, 14 aa, Homo sapiens
AQLLQGLGFNLTER

SEQ ID NO: 70822 - protein, 32 aa, Homo sapiens
AQLLQGLGFNLTERSETEIHQGFQHLHQLFAK

SEQ ID NO: 70823 - protein, 30 aa, Homo sapiens
AVLQLNEEGVDTAGSTGVTLNLTSKPIILR

SEQ ID NO: 70824 - protein, 13 aa, Homo sapiens
EENFYVDETTVVK

SEQ ID NO: 70825 - protein, 22 aa, Homo sapiens
FNQPFIIMIFDHFTWSSLFLAR

SEQ ID NO: 70826 - protein, 9 aa, Homo sapiens
FTNQANFSR

SEQ ID NO: 70827 - protein, 9 aa, Homo sapiens
GLGFNLTER

SEQ ID NO: 70828 - protein, 13 aa, Homo sapiens
GTWTQPFDLASTR

SEQ ID NO: 70829 - protein, 26 aa, Homo sapiens
GTWTQPFDLASTREENFYVDETTVVK

SEQ ID NO: 70830 - protein, 8 aa, Homo sapiens
HLVALSPK

SEQ ID NO: 70831 - protein, 20 aa, Homo sapiens
HYYESEVLAMNFQDWATASR

SEQ ID NO: 70832 - protein, 8 aa, Homo sapiens
ITQDAQLK

SEQ ID NO: 70833 - protein, 11 aa, Homo sapiens
ITQDAQLKSSK

SEQ ID NO: 70834 - protein, 15 aa, Homo sapiens
ITQDAQLKSSKVVHK

SEQ ID NO: 70835 - protein, 23 aa, Homo sapiens
IVDLFSGLDSPAILVLVNYIFFK

SEQ ID NO: 70836 - protein, 32 aa, Homo sapiens
KAVLQLNEEGVDTAGSTGVTLNLTSKPIILRF

SEQ ID NO: 70837 - protein, 26 aa, Homo sapiens
KNIFISPVSISMALAMLSLGTCGHTR

SEQ ID NO: 70838 - protein, 32 aa, Homo sapiens
KVTISGVYDLGDVLEEMGIADLFTNQANFSRI

SEQ ID NO: 70839 - protein, 12 aa, Homo sapiens
LLQGLGFNLTER

SEQ ID NO: 70840 - protein, 15 aa, Homo sapiens
MDPNAAYVNMSNHHR

SEQ ID NO: 70841 - protein, 10 aa, Homo sapiens
MNTVIAALSR

SEQ ID NO: 70842 - protein, 13 aa, Homo sapiens
NAAYVNMSNHHRG

SEQ ID NO: 70843 - protein, 25 aa, Homo sapiens
NIFISPVSISMALAMLSLGTCGHTR

SEQ ID NO: 70844 - protein, 15 aa, Homo sapiens
PDKGKMNTVIAALSR

SEQ ID NO: 70845 - protein, 8 aa, Homo sapiens
PFDLASTR

SEQ ID NO: 70846 - protein, 13 aa, Homo sapiens
PNAAYVNMSNHHR

SEQ ID NO: 70847 - protein, 16 aa, Homo sapiens
RAQLLQGLGFNLTERS

SEQ ID NO: 70848 - protein, 18 aa, Homo sapiens
SETEIHQGFQHLHQLFAK

SEQ ID NO: 70849 - protein, 16 aa, Homo sapiens
TEIHQGFQHLHQLFAK

SEQ ID NO: 70850 - protein, 16 aa, Homo sapiens
VGNGTVFFILPDKGKM

SEQ ID NO: 70851 - protein, 30 aa, Homo sapiens
VTISGVYDLGDVLEEMGIADLFTNQANFSR

SEQ ID NO: 70852 - protein, 16 aa, Homo sapiens
WSAGLTSSQVDLYIPK

SEQ ID NO: 70853 - protein, 13 aa, Homo sapiens
ACHSSQPNATLYK

SEQ ID NO: 70854 - protein, 13 aa, Homo sapiens
ADFSGLTEDNGLK

SEQ ID NO: 70855 - protein, 11 aa, Homo sapiens
AQWANPFDPSK

SEQ ID NO: 70856 - protein, 22 aa, Homo sapiens
AQWANPFDPSKTEDSSSFLIDK

SEQ ID NO: 70857 - protein, 21 aa, Homo sapiens
ASPEGKVTACHSSQPNATLYK

SEQ ID NO: 70858 - protein, 8 aa, Homo sapiens
AVLHIGEK

SEQ ID NO: 70859 - protein, 18 aa, Homo sapiens
AYSENADFSGLTEDNGLK

SEQ ID NO: 70860 - protein, 14 aa, Homo sapiens
EGQMESVEAAMSSK

SEQ ID NO: 70861 - protein, 11 aa, Homo sapiens
ELELQIGNALF

SEQ ID NO: 70862 - protein, 14 aa, Homo sapiens
ELELQIGNALFIGK

SEQ ID NO: 70863 - protein, 14 aa, Homo sapiens
EVFSTDFSNISAAK

SEQ ID NO: 70864 - protein, 7 aa, Homo sapiens
FAFNLYR

SEQ ID NO: 70865 - protein, 15 aa, Homo sapiens
FSISATYDLGATLLK

SEQ ID NO: 70866 - protein, 12 aa, Homo sapiens
FSTDFSNISAAK

SEQ ID NO: 70867 - protein, 8 aa, Homo sapiens
FTVETPDK

SEQ ID NO: 70868 - protein, 29 aa, Homo sapiens
GTEAAAVPEVELSDQPENTFLHPIIQIDR

SEQ ID NO: 70869 - protein, 9 aa, Homo sapiens
GWVDLFVPK

SEQ ID NO: 70870 - protein, 7 aa, Homo sapiens
HLKPLAK

SEQ ID NO: 70871 - protein, 15 aa, Homo sapiens
KELELQIGNALFIGK

SEQ ID NO: 70872 - protein, 21 aa, Homo sapiens
KTLYETEVFSTDFSNISAAKQ

SEQ ID NO: 70873 - protein, 36 aa, Homo sapiens
KTTTVQVPMMHQMEQYYHLVDMELNCTVLQMDYSKN

SEQ ID NO: 70874 - protein, 17 aa, Homo sapiens
KVTACHSSQPNATLYKM

SEQ ID NO: 70875 - protein, 13 aa, Homo sapiens
LLQKGWVDLFVPK

SEQ ID NO: 70876 - protein, 18 aa, Homo sapiens
LSDQPENTFLHPIIQIDR

SEQ ID NO: 70877 - protein, 7 aa, Homo sapiens
MGIQHAY

SEQ ID NO: 70878 - protein, 23 aa, Homo sapiens
MGIQHAYSENADFSGLTEDNGLK

SEQ ID NO: 70879 - protein, 14 aa, Homo sapiens
MSSINADFAFNLYR

SEQ ID NO: 70880 - protein, 10 aa, Homo sapiens
NALALFVLPK

SEQ ID NO: 70881 - protein, 15 aa, Homo sapiens
NIFFSPVSISAALVM

SEQ ID NO: 70882 - protein, 14 aa, Homo sapiens
PENTFLHPIIQIDR

SEQ ID NO: 70883 - protein, 22 aa, Homo sapiens
PEVELSDQPENTFLHPIIQIDR

SEQ ID NO: 70884 - protein, 12 aa, Homo sapiens
QEINSHVEMQTK

SEQ ID NO: 70885 - protein, 16 aa, Homo sapiens
SENADFSGLTEDNGLK

SEQ ID NO: 70886 - protein, 9 aa, Homo sapiens
SFMLLILER

SEQ ID NO: 70887 - protein, 7 aa, Homo sapiens
SILFLGK

SEQ ID NO: 70888 - protein, 14 aa, Homo sapiens
TACHSSQPNATLYK

SEQ ID NO: 70889 - protein, 11 aa, Homo sapiens
TEDSSSFLIDK

SEQ ID NO: 70890 - protein, 15 aa, Homo sapiens
TEVFSTDFSNISAAK

SEQ ID NO: 70891 - protein, 19 aa, Homo sapiens
TLYETEVFSTDFSNISAAK

SEQ ID NO: 70892 - protein, 34 aa, Homo sapiens
TTTVQVPMMHQMEQYYHLVDMELNCTVLQMDYSK

SEQ ID NO: 70893 - protein, 13 aa, Homo sapiens
VFSTDFSNISAAK

SEQ ID NO: 70894 - protein, 15 aa, Homo sapiens
VTACHSSQPNATLYK

SEQ ID NO: 70895 - protein, 11 aa, Homo sapiens
VVGLIQDLKPN

SEQ ID NO: 70896 - protein, 14 aa, Homo sapiens
AAINKWVSNKTEGR

SEQ ID NO: 70897 - protein, 16 aa, Homo sapiens
ADGESCSASMMYQEGK

SEQ ID NO: 70898 - protein, 18 aa, Homo sapiens
ADGESCSASMMYQEGKFR

SEQ ID NO: 70899 - protein, 23 aa, Homo sapiens
AFLEVNEEGSEAAASTAVVIAGR

SEQ ID NO: 70900 - protein, 10 aa, Homo sapiens
ANRPFLVFIR

SEQ ID NO: 70901 - protein, 22 aa, Homo sapiens
ANRPFLVFIREVPLNTIIFMGR

SEQ ID NO: 70902 - protein, 10 aa, Homo sapiens
ATEDEGSEQK

SEQ ID NO: 70903 - protein, 16 aa, Homo sapiens
ATEDEGSEQKIPEATN

SEQ ID NO: 70904 - protein, 17 aa, Homo sapiens
ATEDEGSEQKIPEATNR

SEQ ID NO: 70905 - protein, 18 aa, Homo sapiens
ATEDEGSEQKIPEATNRR

SEQ ID NO: 70906 - protein, 24 aa, Homo sapiens
ATEDEGSEQKIPEATNRRVWELSK

SEQ ID NO: 70907 - protein, 12 aa, Homo sapiens
ATTFYQHLADSK

SEQ ID NO: 70908 - protein, 13 aa, Homo sapiens
CNDTLQQLMEVFK

SEQ ID NO: 70909 - protein, 11 aa, Homo sapiens
DDLYVSDAFHK

SEQ ID NO: 70910 - protein, 11 aa, Homo sapiens
DIPMNPMCIYR

SEQ ID NO: 70911 - protein, 16 aa, Homo sapiens
DIPMNPMCIYRSPEKK

SEQ ID NO: 70912 - protein, 10 aa, Homo sapiens
DISELVYGAK

SEQ ID NO: 70913 - protein, 10 aa, Homo sapiens
DLYVSDAFHK

SEQ ID NO: 70914 - protein, 20 aa, Homo sapiens
DNDNIFLSPLSISTAFAMTK

SEQ ID NO: 70915 - protein, 9 aa, Homo sapiens
DQIHFFFAK

SEQ ID NO: 70916 - protein, 11 aa, Homo sapiens
DTLQQLMEVFK

SEQ ID NO: 70917 - protein, 18 aa, Homo sapiens
DTLQQLMEVFKFDTISEK

SEQ ID NO: 70918 - protein, 26 aa, Homo sapiens
EGTQVLELPFKGDDITMVLILPKPEK

SEQ ID NO: 70919 - protein, 21 aa, Homo sapiens
ELFYKADGESCSASMMYQEGK

SEQ ID NO: 70920 - protein, 23 aa, Homo sapiens
ELFYKADGESCSASMMYQEGKFR

SEQ ID NO: 70921 - protein, 25 aa, Homo sapiens
ELTPEVLQEWLDELEEMMLVVHMPR

SEQ ID NO: 70922 - protein, 12 aa, Homo sapiens
EQLQDMGLVDLF

SEQ ID NO: 70923 - protein, 16 aa, Homo sapiens
EQLQDMGLVDLFSPEK

SEQ ID NO: 70924 - protein, 14 aa, Homo sapiens
ETYQDISELVYGAK

SEQ ID NO: 70925 - protein, 9 aa, Homo sapiens
EVPLNTIIF

SEQ ID NO: 70926 - protein, 12 aa, Homo sapiens
EVPLNTIIFMGR

SEQ ID NO: 70927 - protein, 10 aa, Homo sapiens
FATTFYQHLA

SEQ ID NO: 70928 - protein, 13 aa, Homo sapiens
FATTFYQHLADSK

SEQ ID NO: 70929 - protein, 14 aa, Homo sapiens
FATTFYQHLADSKN

SEQ ID NO: 70930 - protein, 34 aa, Homo sapiens
FATTFYQHLADSKNDNDNIFLSPLSISTAFAMTK

SEQ ID NO: 70931 - protein, 7 aa, Homo sapiens
FDTISEK

SEQ ID NO: 70932 - protein, 10 aa, Homo sapiens
FRIEDGFSLK

SEQ ID NO: 70933 - protein, 26 aa, Homo sapiens
FRIEDGFSLKEQLQDMGLVDLFSPEK

SEQ ID NO: 70934 - protein, 7 aa, Homo sapiens
FSPENTR

SEQ ID NO: 70935 - protein, 12 aa, Homo sapiens
GDDITMVLILPK

SEQ ID NO: 70936 - protein, 15 aa, Homo sapiens
GDDITMVLILPKPEK

SEQ ID NO: 70937 - protein, 12 aa, Homo sapiens
GSPVDICTAKPR

SEQ ID NO: 70938 - protein, 11 aa, Homo sapiens
HGSPVDICTAK

SEQ ID NO: 70939 - protein, 13 aa, Homo sapiens
HGSPVDICTAKPR

SEQ ID NO: 70940 - protein, 8 aa, Homo sapiens
IEDGFSLK

SEQ ID NO: 70941 - protein, 24 aa, Homo sapiens
IEDGFSLKEQLQDMGLVDLFSPEK

SEQ ID NO: 70942 - protein, 16 aa, Homo sapiens
IFLSPLSISTAFAMTK

SEQ ID NO: 70943 - protein, 7 aa, Homo sapiens
IPEATNR

SEQ ID NO: 70944 - protein, 20 aa, Homo sapiens
ITDVIPSEAINELTVLVLVN

SEQ ID NO: 70945 - protein, 25 aa, Homo sapiens
ITDVIPSEAINELTVLVLVNTIYFK

SEQ ID NO: 70946 - protein, 29 aa, Homo sapiens
ITDVIPSEAINELTVLVLVNTIYFKGLWK

SEQ ID NO: 70947 - protein, 11 aa, Homo sapiens
KATEDEGSEQK

SEQ ID NO: 70948 - protein, 18 aa, Homo sapiens
KATEDEGSEQKIPEATNR

SEQ ID NO: 70949 - protein, 19 aa, Homo sapiens
KATEDEGSEQKIPEATNRR

SEQ ID NO: 70950 - protein, 25 aa, Homo sapiens
KATEDEGSEQKIPEATNRRVWELSK

SEQ ID NO: 70951 - protein, 6 aa, Homo sapiens
KELFYK

SEQ ID NO: 70952 - protein, 18 aa, Homo sapiens
KLGACNDTLQQLMEVFKF

SEQ ID NO: 70953 - protein, 21 aa, Homo sapiens
KSLTFNETYQDISELVYGAKL

SEQ ID NO: 70954 - protein, 11 aa, Homo sapiens
KWVSNKTEGRI

SEQ ID NO: 70955 - protein, 21 aa, Homo sapiens
LELPFKGDDITMVLILPKPEK

SEQ ID NO: 70956 - protein, 24 aa, Homo sapiens
LFGDKSLTFNETYQDISELVYGAK

SEQ ID NO: 70957 - protein, 16 aa, Homo sapiens
LGACNDTLQQLMEVFK

SEQ ID NO: 70958 - protein, 23 aa, Homo sapiens
LGACNDTLQQLMEVFKFDTISEK

SEQ ID NO: 70959 - protein, 9 aa, Homo sapiens
LPGIVAEGR

SEQ ID NO: 70960 - protein, 20 aa, Homo sapiens
LPGIVAEGRDDLYVSDAFHK

SEQ ID NO: 70961 - protein, 7 aa, Homo sapiens
LQPLDFK

SEQ ID NO: 70962 - protein, 14 aa, Homo sapiens
LQPLDFKENAEQSR

SEQ ID NO: 70963 - protein, 16 aa, Homo sapiens
LQQLMEVFKFDTISEK

SEQ ID NO: 70964 - protein, 11 aa, Homo sapiens
LVSANRLFGDK

SEQ ID NO: 70965 - protein, 30 aa, Homo sapiens
LVSANRLFGDKSLTFNETYQDISELVYGAK

SEQ ID NO: 70966 - protein, 8 aa, Homo sapiens
MLVVHMPR

SEQ ID NO: 70967 - protein, 14 aa, Homo sapiens
MYSNVIGTVTSGKR

SEQ ID NO: 70968 - protein, 11 aa, Homo sapiens
NDNDNIFLSPL

SEQ ID NO: 70969 - protein, 17 aa, Homo sapiens
NDNDNIFLSPLSISTAF

SEQ ID NO: 70970 - protein, 21 aa, Homo sapiens
NDNDNIFLSPLSISTAFAMTK

SEQ ID NO: 70971 - protein, 37 aa, Homo sapiens
NDNDNIFLSPLSISTAFAMTKLGACNDTLQQLMEVFK

SEQ ID NO: 70972 - protein, 12 aa, Homo sapiens
NDTLQQLMEVFK

SEQ ID NO: 70973 - protein, 19 aa, Homo sapiens
NDTLQQLMEVFKFDTISEK

SEQ ID NO: 70974 - protein, 15 aa, Homo sapiens
NETYQDISELVYGAK

SEQ ID NO: 70975 - protein, 9 aa, Homo sapiens
NRPFLVFIR

SEQ ID NO: 70976 - protein, 18 aa, Homo sapiens
PFKGDDITMVLILPKPEK

SEQ ID NO: 70977 - protein, 7 aa, Homo sapiens
PFLVFIR

SEQ ID NO: 70978 - protein, 8 aa, Homo sapiens
PGIVAEGR

SEQ ID NO: 70979 - protein, 19 aa, Homo sapiens
PGIVAEGRDDLYVSDAFHK

SEQ ID NO: 70980 - protein, 5 aa, Homo sapiens
PLDFK

SEQ ID NO: 70981 - protein, 12 aa, Homo sapiens
PLDFKENAEQSR

SEQ ID NO: 70982 - protein, 10 aa, Homo sapiens
PLNTIIFMGR

SEQ ID NO: 70983 - protein, 9 aa, Homo sapiens
PMNPMCIYR

SEQ ID NO: 70984 - protein, 14 aa, Homo sapiens
PMNPMCIYRSPEKK

SEQ ID NO: 70985 - protein, 14 aa, Homo sapiens
RVAEGTQVLELPFK

SEQ ID NO: 70986 - protein, 29 aa, Homo sapiens
RVAEGTQVLELPFKGDDITMVLILPKPEK

SEQ ID NO: 70987 - protein, 7 aa, Homo sapiens
RVWELSK

SEQ ID NO: 70988 - protein, 11 aa, Homo sapiens
RVWELSKANSR

SEQ ID NO: 70989 - protein, 10 aa, Homo sapiens
SDQIHFFFAK

SEQ ID NO: 70990 - protein, 8 aa, Homo sapiens
SELVYGAK

SEQ ID NO: 70991 - protein, 10 aa, Homo sapiens
SISTAFAMTK

SEQ ID NO: 70992 - protein, 9 aa, Homo sapiens
SKFSPENTR

SEQ ID NO: 70993 - protein, 11 aa, Homo sapiens
SKLPGIVAEGR

SEQ ID NO: 70994 - protein, 21 aa, Homo sapiens
SKLPGIVAEGRDDLYVSDAFH

SEQ ID NO: 70995 - protein, 22 aa, Homo sapiens
SKLPGIVAEGRDDLYVSDAFHK

SEQ ID NO: 70996 - protein, 32 aa, Homo sapiens
SLAKVEKELTPEVLQEWLDELEEMMLVVHMPR

SEQ ID NO: 70997 - protein, 10 aa, Homo sapiens
SLNPNRVTFK

SEQ ID NO: 70998 - protein, 19 aa, Homo sapiens
SLTFNETYQDISELVYGAK

SEQ ID NO: 70999 - protein, 22 aa, Homo sapiens
SPEKKATEDEGSEQKIPEATNR

SEQ ID NO: 71000 - protein, 23 aa, Homo sapiens
SPEKKATEDEGSEQKIPEATNRR

SEQ ID NO: 71001 - protein, 29 aa, Homo sapiens
SPEKKATEDEGSEQKIPEATNRRVWELSK

SEQ ID NO: 71002 - protein, 36 aa, Homo sapiens
SPLSISTAFAMTKLGACNDTLQQLMEVFKFDTISEK

SEQ ID NO: 71003 - protein, 11 aa, Homo sapiens
SPVDICTAKPR

SEQ ID NO: 71004 - protein, 33 aa, Homo sapiens
SSKLVSANRLFGDKSLTFNETYQDISELVYGAK

SEQ ID NO: 71005 - protein, 24 aa, Homo sapiens
TDVIPSEAINELTVLVLVNTIYFK

SEQ ID NO: 71006 - protein, 17 aa, Homo sapiens
TFNETYQDISELVYGAK

SEQ ID NO: 71007 - protein, 10 aa, Homo sapiens
TFYQHLADSK

SEQ ID NO: 71008 - protein, 11 aa, Homo sapiens
TMVLILPKPEK

SEQ ID NO: 71009 - protein, 8 aa, Homo sapiens
TSDQIHFF

SEQ ID NO: 71010 - protein, 9 aa, Homo sapiens
TSDQIHFFF

SEQ ID NO: 71011 - protein, 11 aa, Homo sapiens
TSDQIHFFFAK

SEQ ID NO: 71012 - protein, 15 aa, Homo sapiens
TSDQIHFFFAKLNCR

SEQ ID NO: 71013 - protein, 11 aa, Homo sapiens
TTFYQHLADSK

SEQ ID NO: 71014 - protein, 13 aa, Homo sapiens
TYQDISELVYGAK

SEQ ID NO: 71015 - protein, 13 aa, Homo sapiens
VAEGTQVLELPFK

SEQ ID NO: 71016 - protein, 28 aa, Homo sapiens
VAEGTQVLELPFKGDDITMVLILPKPEK

SEQ ID NO: 71017 - protein, 32 aa, Homo sapiens
VAEGTQVLELPFKGDDITMVLILPKPEKSLAK

SEQ ID NO: 71018 - protein, 28 aa, Homo sapiens
VEKELTPEVLQEWLDELEEMMLVVHMPR

SEQ ID NO: 71019 - protein, 9 aa, Homo sapiens
VLVNTIYFK

SEQ ID NO: 71020 - protein, 29 aa, Homo sapiens
VSANRLFGDKSLTFNETYQDISELVYGAK

SEQ ID NO: 71021 - protein, 6 aa, Homo sapiens
VWELSK

SEQ ID NO: 71022 - protein, 10 aa, Homo sapiens
VWELSKANSR

SEQ ID NO: 71023 - protein, 9 aa, Homo sapiens
WVSNKTEGR

SEQ ID NO: 71024 - protein, 12 aa, Homo sapiens
YQDISELVYGAK

SEQ ID NO: 71025 - protein, 8 aa, Homo sapiens
YQHLADSK

SEQ ID NO: 71026 - protein, 31 aa, Homo sapiens
YRRVAEGTQVLELPFKGDDITMVLILPKPEK

SEQ ID NO: 71027 - protein, 11 aa, Homo sapiens
ADPQWEQLNNK

SEQ ID NO: 71028 - protein, 24 aa, Homo sapiens
ADPQWEQLNNKNLSMPLLPADFHK

SEQ ID NO: 71029 - protein, 13 aa, Homo sapiens
DALENIDPATQMM

SEQ ID NO: 71030 - protein, 21 aa, Homo sapiens
DALENIDPATQMMILNCIYFK

SEQ ID NO: 71031 - protein, 22 aa, Homo sapiens
DALENIDPATQMMILNCIYFKG

SEQ ID NO: 71032 - protein, 8 aa, Homo sapiens
DFVNASSK

SEQ ID NO: 71033 - protein, 19 aa, Homo sapiens
DFVNASSKYEITTIHNLFR

SEQ ID NO: 71034 - protein, 28 aa, Homo sapiens
DQVNTFDNIFIAPVGISTAMGMISLGLK

SEQ ID NO: 71035 - protein, 23 aa, Homo sapiens
ENTVTNDWIPEGEEDDDYLDLEK

SEQ ID NO: 71036 - protein, 6 aa, Homo sapiens
EVLLPK

SEQ ID NO: 71037 - protein, 20 aa, Homo sapiens
EYYFAEAQIADFSDPAFISK

SEQ ID NO: 71038 - protein, 17 aa, Homo sapiens
FAEAQIADFSDPAFISK

SEQ ID NO: 71039 - protein, 14 aa, Homo sapiens
FKLEKNYNLVESLK

SEQ ID NO: 71040 - protein, 12 aa, Homo sapiens
FPVEMTHNHNFR

SEQ ID NO: 71041 - protein, 9 aa, Homo sapiens
FTVDRPFLF

SEQ ID NO: 71042 - protein, 10 aa, Homo sapiens
FTVDRPFLFL

SEQ ID NO: 71043 - protein, 15 aa, Homo sapiens
FTVDRPFLFLIYEHR

SEQ ID NO: 71044 - protein, 12 aa, Homo sapiens
GETHEQVHSILH

SEQ ID NO: 71045 - protein, 14 aa, Homo sapiens
GETHEQVHSILHFK

SEQ ID NO: 71046 - protein, 22 aa, Homo sapiens
GETHEQVHSILHFKDFVNASSK

SEQ ID NO: 71047 - protein, 33 aa, Homo sapiens
GETHEQVHSILHFKDFVNASSKYEITTIHNLFR

SEQ ID NO: 71048 - protein, 18 aa, Homo sapiens
GGETAQSADPQWEQLNNK

SEQ ID NO: 71049 - protein, 31 aa, Homo sapiens
GGETAQSADPQWEQLNNKNLSMPLLPADFHK

SEQ ID NO: 71050 - protein, 33 aa, Homo sapiens
GNFLAANDQELDCDILQLEYVGGISMLIVVPHK

SEQ ID NO: 71051 - protein, 8 aa, Homo sapiens
GPLDQLEK

SEQ ID NO: 71052 - protein, 18 aa, Homo sapiens
GSWVNKFPVEMTHNHNFR

SEQ ID NO: 71053 - protein, 15 aa, Homo sapiens
HQGTITVNEEGTQAT

SEQ ID NO: 71054 - protein, 22 aa, Homo sapiens
HQGTITVNEEGTQATTVTTVGF

SEQ ID NO: 71055 - protein, 25 aa, Homo sapiens
HQGTITVNEEGTQATTVTTVGFMPL

SEQ ID NO: 71056 - protein, 30 aa, Homo sapiens
HQGTITVNEEGTQATTVTTVGFMPLSTQVR

SEQ ID NO: 71057 - protein, 12 aa, Homo sapiens
IADFSDPAFISK

SEQ ID NO: 71058 - protein, 7 aa, Homo sapiens
IAIDLFK

SEQ ID NO: 71059 - protein, 36 aa, Homo sapiens
IFSEDDDYIDIVDSLSVSPTDSDVSAGNILQLFHGK

SEQ ID NO: 71060 - protein, 8 aa, Homo sapiens
ILQLFHGK

SEQ ID NO: 71061 - protein, 10 aa, Homo sapiens
KDFVNASSKY

SEQ ID NO: 71062 - protein, 15 aa, Homo sapiens
KNLSMPLLPADFHKE

SEQ ID NO: 71063 - protein, 12 aa, Homo sapiens
LEKNYNLVESLK

SEQ ID NO: 71064 - protein, 15 aa, Homo sapiens
LNEREVVKVSMMQTK

SEQ ID NO: 71065 - protein, 7 aa, Homo sapiens
LNILNAK

SEQ ID NO: 71066 - protein, 16 aa, Homo sapiens
MLFDKNGNMAGISDQR

SEQ ID NO: 71067 - protein, 21 aa, Homo sapiens
MQTKGNFLAANDQELDCDILQ

SEQ ID NO: 71068 - protein, 7 aa, Homo sapiens
NFGYTLR

SEQ ID NO: 71069 - protein, 11 aa, Homo sapiens
NGNMAGISDQR

SEQ ID NO: 71070 - protein, 13 aa, Homo sapiens
NLSMPLLPADFHK

SEQ ID NO: 71071 - protein, 9 aa, Homo sapiens
NYNLVESLK

SEQ ID NO: 71072 - protein, 14 aa, Homo sapiens
NYNLVESLKLMGIR

SEQ ID NO: 71073 - protein, 10 aa, Homo sapiens
PFLFLIYEHR

SEQ ID NO: 71074 - protein, 9 aa, Homo sapiens
PQWEQLNNK

SEQ ID NO: 71075 - protein, 22 aa, Homo sapiens
PQWEQLNNKNLSMPLLPADFHK

SEQ ID NO: 71076 - protein, 11 aa, Homo sapiens
PVEMTHNHNFR

SEQ ID NO: 71077 - protein, 9 aa, Homo sapiens
QFPILLDFK

SEQ ID NO: 71078 - protein, 13 aa, Homo sapiens
QIADFSDPAFISK

SEQ ID NO: 71079 - protein, 8 aa, Homo sapiens
RNFGYTLR

SEQ ID NO: 71080 - protein, 12 aa, Homo sapiens
SADPQWEQLNNK

SEQ ID NO: 71081 - protein, 9 aa, Homo sapiens
SVNDLYIQK

SEQ ID NO: 71082 - protein, 9 aa, Homo sapiens
TLEAQLTPR

SEQ ID NO: 71083 - protein, 7 aa, Homo sapiens
TNNHIMK

SEQ ID NO: 71084 - protein, 8 aa, Homo sapiens
TREVLLPK

SEQ ID NO: 71085 - protein, 9 aa, Homo sapiens
TSCLLFMGR

SEQ ID NO: 71086 - protein, 22 aa, Homo sapiens
VREYYFAEAQIADFSDPAFISK

SEQ ID NO: 71087 - protein, 7 aa, Homo sapiens
VSMMQTK

SEQ ID NO: 71088 - protein, 11 aa, Homo sapiens
YEITTIHNLFR

SEQ ID NO: 71089 - protein, 12 aa, Homo sapiens
YEITTIHNLFRK

SEQ ID NO: 71090 - protein, 33 aa, Homo sapiens
AMVNTTQQQGLSNASTEGPVADAFNNSSISIKE

SEQ ID NO: 71091 - protein, 23 aa, Homo sapiens
RNVFLLSAAVNISGLVFYLIFGR

SEQ ID NO: 71092 - protein, 24 aa, Homo sapiens
RARAMGINATFANIAGALAPLMMI

SEQ ID NO: 71093 - protein, 16 aa, Homo sapiens
KYNVTVIQYIGELLRY

SEQ ID NO: 71094 - protein, 20 aa, Homo sapiens
MDQNQHLNKTAEAQPSENKK

SEQ ID NO: 71095 - protein, 10 aa, Homo sapiens
AQQVQGVHAR

SEQ ID NO: 71096 - protein, 9 aa, Homo sapiens
DALSASVVK

SEQ ID NO: 71097 - protein, 12 aa, Homo sapiens
FPVYDYDPSSLR

SEQ ID NO: 71098 - protein, 21 aa, Homo sapiens
FPVYDYDPSSLRDALSASVVK

SEQ ID NO: 71099 - protein, 12 aa, Homo sapiens
VNSQSLSPYLFR

SEQ ID NO: 71100 - protein, 12 aa, Homo sapiens
VSAQQVQGVHAR

SEQ ID NO: 71101 - protein, 16 aa, Homo sapiens
RSMAIMNNVSLALHRC

SEQ ID NO: 71102 - protein, 13 aa, Homo sapiens
AIMNNMSLIIHRS

SEQ ID NO: 71103 - protein, 17 aa, Homo sapiens
RCNTTQGNEVTSILRWA

SEQ ID NO: 71104 - protein, 32 aa, Homo sapiens
KRLTPNYTLGANGYVFAIDLNGYVLLHPNLKP

SEQ ID NO: 71105 - protein, 10 aa, Homo sapiens
DLNAELFDCK

SEQ ID NO: 71106 - protein, 33 aa, Homo sapiens
FLTSIPTGIPEDATTLYLQNNQINNAGIPSDLK

SEQ ID NO: 71107 - protein, 30 aa, Homo sapiens
KEEFVIHTIFPPNGMNLYKNNHSESSSNRS

SEQ ID NO: 71108 - protein, 16 aa, Homo sapiens
KMTFNGSCSSVCTWKS

SEQ ID NO: 71109 - protein, 10 aa, Homo sapiens
LVDTLPQKPR

SEQ ID NO: 71110 - protein, 27 aa, Homo sapiens
VIETLLMDTPSSYEAAMELFSPDQDMR

SEQ ID NO: 71111 - protein, 14 aa, Homo sapiens
HGFSNATQITSSKF

SEQ ID NO: 71112 - protein, 26 aa, Homo sapiens
RFMGPASGMNMSGMGGLGSLGDVSKN

SEQ ID NO: 71113 - protein, 10 aa, Homo sapiens
DTTILHLSEN

SEQ ID NO: 71114 - protein, 11 aa, Homo sapiens
GLGELQELYLK

SEQ ID NO: 71115 - protein, 16 aa, Homo sapiens
GLGELQELYLKGNELK

SEQ ID NO: 71116 - protein, 25 aa, Homo sapiens
KVASHLEVNCDKRNLTALPPDLPKD

SEQ ID NO: 71117 - protein, 8 aa, Homo sapiens
LTQLNLDR

SEQ ID NO: 71118 - protein, 10 aa, Homo sapiens
LTSLPLGALR

SEQ ID NO: 71119 - protein, 23 aa, Homo sapiens
VASHLEVNCDKRNLTALPPDLPK

SEQ ID NO: 71120 - protein, 13 aa, Homo sapiens
WLQDNAENVYVWK

SEQ ID NO: 71121 - protein, 10 aa, Homo sapiens
LWTLVSEQTR

SEQ ID NO: 71122 - protein, 12 aa, Homo sapiens
NQSFCPTVNLDK

SEQ ID NO: 71123 - protein, 13 aa, Homo sapiens
RNQSFCPTVNLDK

SEQ ID NO: 71124 - protein, 7 aa, Homo sapiens
KPGESLK

SEQ ID NO: 71125 - protein, 10 aa, Homo sapiens
TAYLQWSSLK

SEQ ID NO: 71126 - protein, 11 aa, Homo sapiens
VQLVQSGAEVK

SEQ ID NO: 71127 - protein, 15 aa, Homo sapiens
DDSKNTAYLQMNSLK

SEQ ID NO: 71128 - protein, 15 aa, Homo sapiens
DNAKNTLYLQMNSLR

SEQ ID NO: 71129 - protein, 14 aa, Homo sapiens
ESGGGLVQPGGSLR

SEQ ID NO: 71130 - protein, 19 aa, Homo sapiens
EVQLVESGGGLVQPGGSLK

SEQ ID NO: 71131 - protein, 19 aa, Homo sapiens
EVQLVESGGGLVQPGGSLR

SEQ ID NO: 71132 - protein, 9 aa, Homo sapiens
FTISRDNAK

SEQ ID NO: 71133 - protein, 7 aa, Homo sapiens
GLEWVGR

SEQ ID NO: 71134 - protein, 7 aa, Homo sapiens
GLVWVSR

SEQ ID NO: 71135 - protein, 15 aa, Homo sapiens
INSDGSSTSYADSVK

SEQ ID NO: 71136 - protein, 19 aa, Homo sapiens
LSCAASGFTFSSYWMHWVR

SEQ ID NO: 71137 - protein, 16 aa, Homo sapiens
LVESGGGLVQPGGSLK

SEQ ID NO: 71138 - protein, 16 aa, Homo sapiens
LVESGGGLVQPGGSLR

SEQ ID NO: 71139 - protein, 11 aa, Homo sapiens
NTAYLQMNSLK

SEQ ID NO: 71140 - protein, 13 aa, Homo sapiens
SDGSSTSYADSVK

SEQ ID NO: 71141 - protein, 13 aa, Homo sapiens
SGGGLVQPGGSLR

SEQ ID NO: 71142 - protein, 11 aa, Homo sapiens
TEDTAVYYCTR

SEQ ID NO: 71143 - protein, 18 aa, Homo sapiens
VQLVESGGGLVQPGGSLR

SEQ ID NO: 71144 - protein, 15 aa, Homo sapiens
EYDTIPHTNRTILKE

SEQ ID NO: 71145 - protein, 22 aa, Homo sapiens
KALGQAANESHNGSILPISWRW

SEQ ID NO: 71146 - protein, 18 aa, Homo sapiens
RYTVSNLSMQTHAARFKT

SEQ ID NO: 71147 - protein, 11 aa, Homo sapiens
KSNGTIIHVKG

SEQ ID NO: 71148 - protein, 14 aa, Homo sapiens
RLLHSDYMNMTPRR

SEQ ID NO: 71149 - protein, 21 aa, Homo sapiens
RVPCSCYNLSATNDSTILDKV

SEQ ID NO: 71150 - protein, 35 aa, Homo sapiens
RSLHNLSTPEVPASVQTVTIESSVTVKIENKESRE

SEQ ID NO: 71151 - protein, 20 aa, Homo sapiens
RNLSGKVILRVTGCPAQRKE

SEQ ID NO: 71152 - protein, 39 aa, Homo sapiens
KNFAQNRGAGNTSSLNPLAVGFVQTPPVISSAHIQDERV

SEQ ID NO: 71153 - protein, 38 aa, Homo sapiens
GDRGPAGPPGIAGMSGKPGAPGPPGVPGEPGERGPVGD

SEQ ID NO: 71154 - protein, 39 aa, Homo sapiens
GEPGIGLPGSPGLPGTSALGLPGSPGAPGPQGPPGPSGR

SEQ ID NO: 71155 - protein, 11 aa, Homo sapiens
GNDEHEAGGLK

SEQ ID NO: 71156 - protein, 36 aa, Homo sapiens
RSAPSGGGASFNLSLTEEHSGNYSCEANNGLGAQRS

SEQ ID NO: 71157 - protein, 17 aa, Homo sapiens
RSEAVTLNFTVPTGARS

SEQ ID NO: 71158 - protein, 27 aa, Homo sapiens
AIPLVLVSGNHDIGNTPTAETVEEFCR

SEQ ID NO: 71159 - protein, 18 aa, Homo sapiens
FFVLCGDLIHAMPGKPWR

SEQ ID NO: 71160 - protein, 11 aa, Homo sapiens
SAAEAGGVFHR

SEQ ID NO: 71161 - protein, 9 aa, Homo sapiens
TEQTEDLKR

SEQ ID NO: 71162 - protein, 32 aa, Homo sapiens
MCPMLLKNGYNGNATPVTTTAPWASLGLSAKT

SEQ ID NO: 71163 - protein, 31 aa, Homo sapiens
KFCHSQLSNNSVSFFLYNLDHSHANYYFCNL

SEQ ID NO: 71164 - protein, 10 aa, Homo sapiens
AEAEALYQTK

SEQ ID NO: 71165 - protein, 12 aa, Homo sapiens
FLEQQNQVLETK

SEQ ID NO: 71166 - protein, 19 aa, Homo sapiens
GGFSGCSAVLSGGSSSSYR

SEQ ID NO: 71167 - protein, 12 aa, Homo sapiens
NLDLDSIIAEVR

SEQ ID NO: 71168 - protein, 12 aa, Homo sapiens
SKAEAEALYQTK

SEQ ID NO: 71169 - protein, 16 aa, Homo sapiens
SLLAPLNVELDPEIQK

SEQ ID NO: 71170 - protein, 17 aa, Homo sapiens
KANFSIGPMMPVLAGTY

SEQ ID NO: 71171 - protein, 18 aa, Homo sapiens
KANFSIGPLMPVLAGTYR

SEQ ID NO: 71172 - protein, 25 aa, Homo sapiens
KTNDTYMKFSWLTVPEESLDKEHRC

SEQ ID NO: 71173 - protein, 14 aa, Homo sapiens
KVVWLFNTSIISKE

SEQ ID NO: 71174 - protein, 17 aa, Homo sapiens
ARSEAAAVQPVIGISQR

SEQ ID NO: 71175 - protein, 15 aa, Homo sapiens
SEAAAVQPVIGISQR

SEQ ID NO: 71176 - protein, 24 aa, Homo sapiens
SGGCFWDNGHLYREDQTSPAPGLR

SEQ ID NO: 71177 - protein, 26 aa, Homo sapiens
YGSGGCFWDNGHLYREDQTSPAPGLR

SEQ ID NO: 71178 - protein, 30 aa, Homo sapiens
KLGVSSVPSCYLIYPNGSHGLINVVKPLRA

SEQ ID NO: 71179 - protein, 8 aa, Homo sapiens
AEIEYLEK

SEQ ID NO: 71180 - protein, 12 aa, Homo sapiens
DNYTDLVAIQNK

SEQ ID NO: 71181 - protein, 15 aa, Homo sapiens
FCRDNYTDLVAIQNK

SEQ ID NO: 71182 - protein, 24 aa, Homo sapiens
GIEETTCGPFGNWSSPEPTCQVIQ

SEQ ID NO: 71183 - protein, 12 aa, Homo sapiens
IGGIWTWVGTNK

SEQ ID NO: 71184 - protein, 14 aa, Homo sapiens
KIGGIWTWVGTNKS

SEQ ID NO: 71185 - protein, 11 aa, Homo sapiens
NKEDCVEIYIK

SEQ ID NO: 71186 - protein, 14 aa, Homo sapiens
RDNYTDLVAIQNKA

SEQ ID NO: 71187 - protein, 17 aa, Homo sapiens
SLTEEAENWGDGEPNNK

SEQ ID NO: 71188 - protein, 18 aa, Homo sapiens
SLTEEAENWGDGEPNNKK

SEQ ID NO: 71189 - protein, 8 aa, Homo sapiens
SYYWIGIR

SEQ ID NO: 71190 - protein, 9 aa, Homo sapiens
SYYWIGIRK

SEQ ID NO: 71191 - protein, 18 aa, Homo sapiens
TICESSGIWSNPSPICQK

SEQ ID NO: 71192 - protein, 14 aa, Homo sapiens
WTYHYSEKPMNWQR

SEQ ID NO: 71193 - protein, 10 aa, Homo sapiens
YTDLVAIQNK

SEQ ID NO: 71194 - protein, 24 aa, Homo sapiens
SAYDSNDPDVESNSSSGISSPSRQ

SEQ ID NO: 71195 - protein, 32 aa, Homo sapiens
KSVNKMQEATPSAQATNETQMCYASLDHSVKG

SEQ ID NO: 71196 - protein, 26 aa, Homo sapiens
RGPGGSCEFCGKHFTNSSNLTVHRRS

SEQ ID NO: 71197 - protein, 12 aa, Homo sapiens
AIFSVGPVSPSR

SEQ ID NO: 71198 - protein, 26 aa, Homo sapiens
SKRQSHKYQAEFPMSPVTSAHAGTYR

SEQ ID NO: 71199 - protein, 36 aa, Homo sapiens
KEIKGIQIGREEVNLSLLADDMILYLENPVVSAQRP

SEQ ID NO: 71200 - protein, 8 aa, Homo sapiens
YLGIQLTR

SEQ ID NO: 71201 - protein, 16 aa, Homo sapiens
KCQAHSQNVTFVLRKV

SEQ ID NO: 71202 - protein, 18 aa, Homo sapiens
KDENSINGTPDITVEIRE

SEQ ID NO: 71203 - protein, 21 aa, Homo sapiens
LINYHQEQAVNCLLGNVFYER

SEQ ID NO: 71204 - protein, 21 aa, Homo sapiens
VGADNHVLPLDCVTLQTFLAK

SEQ ID NO: 71205 - protein, 27 aa, Homo sapiens
KKKLERFNSTRFNLDNLADLENLVQRR

SEQ ID NO: 71206 - protein, 31 aa, Homo sapiens
RIVNATWFTNFILLFILLSSAALAAEDPIRA

SEQ ID NO: 71207 - protein, 16 aa, Homo sapiens
AITDNDMQSILDLHNK

SEQ ID NO: 71208 - protein, 11 aa, Homo sapiens
AVYLVCNYSPK

SEQ ID NO: 71209 - protein, 10 aa, Homo sapiens
GNWWGHAPYK

SEQ ID NO: 71210 - protein, 21 aa, Homo sapiens
SQVYPTASNMEYMTWDVELER

SEQ ID NO: 71211 - protein, 16 aa, Homo sapiens
YRPPTFHVQSWYDEVK

SEQ ID NO: 71212 - protein, 10 aa, Homo sapiens
IYSLNEGYAK

SEQ ID NO: 71213 - protein, 11 aa, Homo sapiens
YVGSMVADVHR

SEQ ID NO: 71214 - protein, 12 aa, Homo sapiens
RIRELTSNFNFT

SEQ ID NO: 71215 - protein, 27 aa, Homo sapiens
KEEDFMQLSPQELISVISNDSLNVEKE

SEQ ID NO: 71216 - protein, 25 aa, Homo sapiens
KKECYYNLNDASLCDNVLAPNVTKQ

SEQ ID NO: 71217 - protein, 20 aa, Homo sapiens
RTCEDIDECVNNTVCDSHGF

SEQ ID NO: 71218 - protein, 33 aa, Homo sapiens
RVNNTFCQDINECQLQGVCPNGECLNTMGSYRC

SEQ ID NO: 71219 - protein, 18 aa, Homo sapiens
GFVPAGESSSEAGGENYK

SEQ ID NO: 71220 - protein, 23 aa, Homo sapiens
ITYVVHPGPGLAAGALPLSGPPR

SEQ ID NO: 71221 - protein, 20 aa, Homo sapiens
TQTIHSTYSHQQVIPHVYPV

SEQ ID NO: 71222 - protein, 15 aa, Homo sapiens
AESVVVSTAIQEFYK

SEQ ID NO: 71223 - protein, 10 aa, Homo sapiens
ELLIHQLEAK

SEQ ID NO: 71224 - protein, 8 aa, Homo sapiens
FEALTEAR

SEQ ID NO: 71225 - protein, 28 aa, Homo sapiens
RSSSGHLFTLPGATPGGDPNSNNSNNKL

SEQ ID NO: 71226 - protein, 11 aa, Homo sapiens
EKETVIIPNEK

SEQ ID NO: 71227 - protein, 10 aa, Homo sapiens
KANDTSYIRD

SEQ ID NO: 71228 - protein, 28 aa, Homo sapiens
KLNNLTFLYLDHNALESVPLNLPESLRV

SEQ ID NO: 71229 - protein, 14 aa, Homo sapiens
KLTAKDFADIPNLR

SEQ ID NO: 71230 - protein, 14 aa, Homo sapiens
LPVLPPKLTLFNAK

SEQ ID NO: 71231 - protein, 13 aa, Homo sapiens
LTAKDFADIPNLR

SEQ ID NO: 71232 - protein, 14 aa, Homo sapiens
NIKEKETVIIPNEK

SEQ ID NO: 71233 - protein, 8 aa, Homo sapiens
RLPIGSYF

SEQ ID NO: 71234 - protein, 27 aa, Homo sapiens
VIHLQFNNIASITDDTFCKANDTSYIR

SEQ ID NO: 71235 - protein, 22 aa, Homo sapiens
RAMVLVNVTDVNDNVPSIDIRY

SEQ ID NO: 71236 - protein, 33 aa, Homo sapiens
RFLIEDINDNAPLFPATVINISIPENSAINSKY

SEQ ID NO: 71237 - protein, 24 aa, Homo sapiens
RYIVNPVNDTVVLSENIPLNTKIA

SEQ ID NO: 71238 - protein, 18 aa, Homo sapiens
ELKPTKPMQFLGDEETVR

SEQ ID NO: 71239 - protein, 19 aa, Homo sapiens
ELKPTKPMQFLGDEETVRK

SEQ ID NO: 71240 - protein, 11 aa, Homo sapiens
HGESTWNQENR

SEQ ID NO: 71241 - protein, 27 aa, Homo sapiens
HLEGMSDQAIMELNLPTGIPIVYELNK

SEQ ID NO: 71242 - protein, 15 aa, Homo sapiens
NEINNMSFLTADNKS

SEQ ID NO: 71243 - protein, 23 aa, Homo sapiens
RHNFTLAFSTAEKLADCAQLLDV

SEQ ID NO: 71244 - protein, 24 aa, Homo sapiens
AEAEENEKETAVSTEDDSHHKAEK

SEQ ID NO: 71245 - protein, 34 aa, Homo sapiens
DQGNQEQDPNISNGEEEEEKEPGEVGTHNDNQER

SEQ ID NO: 71246 - protein, 21 aa, Homo sapiens
EKVHENENIGTTEPGEHQEAK

SEQ ID NO: 71247 - protein, 13 aa, Homo sapiens
GHQLQLDYFGACK

SEQ ID NO: 71248 - protein, 13 aa, Homo sapiens
HIQETEWQSQEGK

SEQ ID NO: 71249 - protein, 25 aa, Homo sapiens
IEEQREKVHENENIGTTEPGEHQEA

SEQ ID NO: 71250 - protein, 8 aa, Homo sapiens
KIYLDEKR

SEQ ID NO: 71251 - protein, 20 aa, Homo sapiens
KKAENSSNEEETSSEGNMRV

SEQ ID NO: 71252 - protein, 26 aa, Homo sapiens
KLSENTDFLAPGVSSFTDSNQQESIT

SEQ ID NO: 71253 - protein, 27 aa, Homo sapiens
KLSENTDFLAPGVSSFTDSNQQESITK

SEQ ID NO: 71254 - protein, 28 aa, Homo sapiens
KLSENTDFLAPGVSSFTDSNQQESITKR

SEQ ID NO: 71255 - protein, 14 aa, Homo sapiens
LLMEPTDDGNTTPR

SEQ ID NO: 71256 - protein, 26 aa, Homo sapiens
LSENTDFLAPGVSSFTDSNQQESITK

SEQ ID NO: 71257 - protein, 21 aa, Homo sapiens
NHGVDDDGDDDGDDGGTDGPR

SEQ ID NO: 71258 - protein, 19 aa, Homo sapiens
REENQEQPRNYSHHQLNRS

SEQ ID NO: 71259 - protein, 23 aa, Homo sapiens
SKEESHEQSAEQGKSSSQELGLK

SEQ ID NO: 71260 - protein, 10 aa, Homo sapiens
TGLEAISNHK

SEQ ID NO: 71261 - protein, 15 aa, Homo sapiens
TGLEAISNHKETEEK

SEQ ID NO: 71262 - protein, 19 aa, Homo sapiens
VHENENIGTTEPGEHQEAK

SEQ ID NO: 71263 - protein, 11 aa, Homo sapiens
VLTHSELAPLR

SEQ ID NO: 71264 - protein, 23 aa, Homo sapiens
VLTHSELAPLRASLVPMEHCITR

SEQ ID NO: 71265 - protein, 34 aa, Homo sapiens
RSPASERRPLGNFTAPPTYTETLSTAPLASWVRS

SEQ ID NO: 71266 - protein, 19 aa, Homo sapiens
KKKKALSSMGANYSSYLAK

SEQ ID NO: 71267 - protein, 12 aa, Homo sapiens
ESLLNFVETVHR

SEQ ID NO: 71268 - protein, 11 aa, Homo sapiens
FSHHSYAQMVR

SEQ ID NO: 71269 - protein, 13 aa, Homo sapiens
HDITTAPDGDYWR

SEQ ID NO: 71270 - protein, 13 aa, Homo sapiens
LIGNIHGNEVAGR

SEQ ID NO: 71271 - protein, 9 aa, Homo sapiens
MFSPTPDEK

SEQ ID NO: 71272 - protein, 13 aa, Homo sapiens
VDFILQPLGMGPK

SEQ ID NO: 71273 - protein, 19 aa, Homo sapiens
KFLALVTMNQSGWGTSGRR

SEQ ID NO: 71274 - protein, 23 aa, Homo sapiens
MNHTVQTFFSPVNSGQPPNYEML

SEQ ID NO: 71275 - protein, 16 aa, Homo sapiens
AISQSGVALSPWVIQK

SEQ ID NO: 71276 - protein, 16 aa, Homo sapiens
ALENPQPHPGWQGTLK

SEQ ID NO: 71277 - protein, 7 aa, Homo sapiens
ALTLAYK

SEQ ID NO: 71278 - protein, 11 aa, Homo sapiens
AMIAYWTNFAK

SEQ ID NO: 71279 - protein, 10 aa, Homo sapiens
DQHMAIAWVK

SEQ ID NO: 71280 - protein, 9 aa, Homo sapiens
GIPFAAPTK

SEQ ID NO: 71281 - protein, 13 aa, Homo sapiens
KLGLLGDSVDIFK

SEQ ID NO: 71282 - protein, 9 aa, Homo sapiens
KVTEEDFYK

SEQ ID NO: 71283 - protein, 16 aa, Homo sapiens
LGAVYTEGGFVEGVNK

SEQ ID NO: 71284 - protein, 17 aa, Homo sapiens
LGAVYTEGGFVEGVNKK

SEQ ID NO: 71285 - protein, 12 aa, Homo sapiens
LGLLGDSVDIFK

SEQ ID NO: 71286 - protein, 9 aa, Homo sapiens
LVSEFTITK

SEQ ID NO: 71287 - protein, 7 aa, Homo sapiens
NPLFWAK

SEQ ID NO: 71288 - protein, 17 aa, Homo sapiens
RAISQSGVALSPWVIQK

SEQ ID NO: 71289 - protein, 30 aa, Homo sapiens
TGDPNMGDSAVPTHWEPYTTENSGYLEITK

SEQ ID NO: 71290 - protein, 19 aa, Homo sapiens
TTFDVYTESWAQDPSQENK

SEQ ID NO: 71291 - protein, 11 aa, Homo sapiens
TYAYLFSHPSR

SEQ ID NO: 71292 - protein, 10 aa, Homo sapiens
VGCPVGDAAR

SEQ ID NO: 71293 - protein, 21 aa, Homo sapiens
VGPLGFLSTGDANLPGNYGLR

SEQ ID NO: 71294 - protein, 8 aa, Homo sapiens
VTEEDFYK

SEQ ID NO: 71295 - protein, 29 aa, Homo sapiens
WVGADHADDIQYVFGKPFATPTGYRPQDR

SEQ ID NO: 71296 - protein, 27 aa, Homo sapiens
MNIMSTLQWAVNSSIDVDSLMRSVSRV

SEQ ID NO: 71297 - protein, 12 aa, Homo sapiens
AYGFRGPGPQLR

SEQ ID NO: 71298 - protein, 21 aa, Homo sapiens
GGKSGELEQEEERLSKEWEDS

SEQ ID NO: 71299 - protein, 23 aa, Homo sapiens
GGKSGELEQEEERLSKEWEDSKR

SEQ ID NO: 71300 - protein, 20 aa, Homo sapiens
GWRPSSREDSLEAGLPLQVR

SEQ ID NO: 71301 - protein, 17 aa, Homo sapiens
HQNLLKELQDLALQGAK

SEQ ID NO: 71302 - protein, 22 aa, Homo sapiens
HSGFEDELSEVLENQSSQAELK

SEQ ID NO: 71303 - protein, 33 aa, Homo sapiens
HSGFEDELSEVLENQSSQAELKEAVEEPSSKDV

SEQ ID NO: 71304 - protein, 35 aa, Homo sapiens
HSGFEDELSEVLENQSSQAELKEAVEEPSSKDVME

SEQ ID NO: 71305 - protein, 28 aa, Homo sapiens
KGESRSEALAVDGAGKPGAEEAQDPEGK

SEQ ID NO: 71306 - protein, 24 aa, Homo sapiens
KHSGFEDELSEVLENQSSQAELKE

SEQ ID NO: 71307 - protein, 16 aa, Homo sapiens
LPVNSPMNKGDTEVMK

SEQ ID NO: 71308 - protein, 10 aa, Homo sapiens
LSKEWEDSKR

SEQ ID NO: 71309 - protein, 21 aa, Homo sapiens
RGWRPSSREDSLEAGLPLQVR

SEQ ID NO: 71310 - protein, 23 aa, Homo sapiens
SEALAVDGAGKPGAEEAQDPEGK

SEQ ID NO: 71311 - protein, 21 aa, Homo sapiens
SGEATDGARPQALPEPMQESK

SEQ ID NO: 71312 - protein, 13 aa, Homo sapiens
SGELEQEEERLSK

SEQ ID NO: 71313 - protein, 18 aa, Homo sapiens
SGELEQEEERLSKEWEDS

SEQ ID NO: 71314 - protein, 20 aa, Homo sapiens
SGELEQEEERLSKEWEDSKR

SEQ ID NO: 71315 - protein, 9 aa, Homo sapiens
VAHQLQALR

SEQ ID NO: 71316 - protein, 9 aa, Homo sapiens
WSKMDQLAK

SEQ ID NO: 71317 - protein, 20 aa, Homo sapiens
YPGPQAEGDSEGLSQGLVDR

SEQ ID NO: 71318 - protein, 22 aa, Homo sapiens
YPGPQAEGDSEGLSQGLVDREK

SEQ ID NO: 71319 - protein, 11 aa, Homo sapiens
SMISNMNASRA

SEQ ID NO: 71320 - protein, 12 aa, Homo sapiens
NTLSLVNDFIIR

SEQ ID NO: 71321 - protein, 25 aa, Homo sapiens
RRGAQSPGVMNGTPSTAGFLVAWPM

SEQ ID NO: 71322 - protein, 7 aa, Homo sapiens
MTAALPK

SEQ ID NO: 71323 - protein, 15 aa, Homo sapiens
SLEHVQFEATIEYSR

SEQ ID NO: 71324 - protein, 20 aa, Homo sapiens
LGEHNIKVLEGNEQFINAAK

SEQ ID NO: 71325 - protein, 8 aa, Homo sapiens
NRPGVYTK

SEQ ID NO: 71326 - protein, 10 aa, Homo sapiens
TLDNDIMLIK

SEQ ID NO: 71327 - protein, 21 aa, Homo sapiens
RHNEQNLSLADVTQQAGLVKS

SEQ ID NO: 71328 - protein, 10 aa, Homo sapiens
AITEKEKIEK

SEQ ID NO: 71329 - protein, 12 aa, Homo sapiens
AITEKEKIEKER

SEQ ID NO: 71330 - protein, 14 aa, Homo sapiens
AITEKEKIEKERQS

SEQ ID NO: 71331 - protein, 20 aa, Homo sapiens
ELSAERPLNEQIAEAEEDKI

SEQ ID NO: 71332 - protein, 21 aa, Homo sapiens
ELSAERPLNEQIAEAEEDKIK

SEQ ID NO: 71333 - protein, 22 aa, Homo sapiens
ELSAERPLNEQIAEAEEDKIKK

SEQ ID NO: 71334 - protein, 15 aa, Homo sapiens
FPKPGGSQDKSLHNR

SEQ ID NO: 71335 - protein, 13 aa, Homo sapiens
GILDKEEAEAIKR

SEQ ID NO: 71336 - protein, 13 aa, Homo sapiens
KLEKNATDNISKL

SEQ ID NO: 71337 - protein, 10 aa, Homo sapiens
KLIDDYDSTK

SEQ ID NO: 71338 - protein, 25 aa, Homo sapiens
KTYPPENKPGQSNYSFVDNLNLLKA

SEQ ID NO: 71339 - protein, 9 aa, Homo sapiens
LIDDYDSTK

SEQ ID NO: 71340 - protein, 17 aa, Homo sapiens
LIDDYDSTKSGLDHKFQ

SEQ ID NO: 71341 - protein, 21 aa, Homo sapiens
QADAYVEKGILDKEEAEAIKR

SEQ ID NO: 71342 - protein, 17 aa, Homo sapiens
SSPLDNKLNVEDVDSTK

SEQ ID NO: 71343 - protein, 19 aa, Homo sapiens
SSPLDNKLNVEDVDSTKNR

SEQ ID NO: 71344 - protein, 20 aa, Homo sapiens
SSPLDNKLNVEDVDSTKNRK

SEQ ID NO: 71345 - protein, 20 aa, Homo sapiens
EFQLHQHLFDPEHDYPGLGK

SEQ ID NO: 71346 - protein, 22 aa, Homo sapiens
EFQLHQHLFDPEHDYPGLGKWN

SEQ ID NO: 71347 - protein, 23 aa, Homo sapiens
EFQLHQHLFDPEHDYPGLGKWNK

SEQ ID NO: 71348 - protein, 14 aa, Homo sapiens
KSVPHFSDEDKDPE

SEQ ID NO: 71349 - protein, 13 aa, Homo sapiens
LLHGVMEQLGIAR

SEQ ID NO: 71350 - protein, 15 aa, Homo sapiens
LLHGVMEQLGIARPR

SEQ ID NO: 71351 - protein, 15 aa, Homo sapiens
NPYLQGQRLDNVVAK

SEQ ID NO: 71352 - protein, 16 aa, Homo sapiens
NPYLQGQRLDNVVAKK

SEQ ID NO: 71353 - protein, 14 aa, Homo sapiens
PYLQGQRLDNVVAK

SEQ ID NO: 71354 - protein, 15 aa, Homo sapiens
PYLQGQRLDNVVAKK

SEQ ID NO: 71355 - protein, 10 aa, Homo sapiens
SVNPYLQGQR

SEQ ID NO: 71356 - protein, 17 aa, Homo sapiens
SVNPYLQGQRLDNVVAK

SEQ ID NO: 71357 - protein, 18 aa, Homo sapiens
SVNPYLQGQRLDNVVAKK

SEQ ID NO: 71358 - protein, 13 aa, Homo sapiens
SVPHFSDEDKDPE

SEQ ID NO: 71359 - protein, 12 aa, Homo sapiens
TPDRVSEADIQR

SEQ ID NO: 71360 - protein, 33 aa, Homo sapiens
LLSEPNQTENDALEPEDLSQAAEQDEMRLELQR

SEQ ID NO: 71361 - protein, 32 aa, Homo sapiens
LSEPNQTENDALEPEDLSQAAEQDEMRLELQR

SEQ ID NO: 71362 - protein, 13 aa, Homo sapiens
SLAAAAGKQELAK

SEQ ID NO: 71363 - protein, 17 aa, Homo sapiens
ALCDQEGWDTPINYSKT

SEQ ID NO: 71364 - protein, 20 aa, Homo sapiens
KGAEIEVDENGTLDLSMKKN

SEQ ID NO: 71365 - protein, 30 aa, Homo sapiens
APPGRPEAQPPPLSSEHKEPVAGDAVPGPK

SEQ ID NO: 71366 - protein, 17 aa, Homo sapiens
ARRPESALLGGSEAGER

SEQ ID NO: 71367 - protein, 9 aa, Homo sapiens
ASWGEFQAR

SEQ ID NO: 71368 - protein, 11 aa, Homo sapiens
AYQGVAAPFPK

SEQ ID NO: 71369 - protein, 24 aa, Homo sapiens
ERVGEEDEEAAEAEAEAEEAERAR

SEQ ID NO: 71370 - protein, 19 aa, Homo sapiens
ESAREEEEAEQERRGGEER

SEQ ID NO: 71371 - protein, 13 aa, Homo sapiens
ETHKFGEGVSSPK

SEQ ID NO: 71372 - protein, 25 aa, Homo sapiens
ETHKFGEGVSSPKTHLGEALAPLSK

SEQ ID NO: 71373 - protein, 25 aa, Homo sapiens
GGEERVGEEDEEAAEAEAEAEEAER

SEQ ID NO: 71374 - protein, 27 aa, Homo sapiens
GGEERVGEEDEEAAEAEAEAEEAERAR

SEQ ID NO: 71375 - protein, 22 aa, Homo sapiens
GLQEAAEERESAREEEEAEQER

SEQ ID NO: 71376 - protein, 23 aa, Homo sapiens
GLQEAAEERESAREEEEAEQERR

SEQ ID NO: 71377 - protein, 27 aa, Homo sapiens
GRPEAQPPPLSSEHKEPVAGDAVPGPK

SEQ ID NO: 71378 - protein, 35 aa, Homo sapiens
GRPEAQPPPLSSEHKEPVAGDAVPGPKDGSAPEVR

SEQ ID NO: 71379 - protein, 31 aa, Homo sapiens
LDRPASPPAPSGSQQGPEEEAAEALLTETVR

SEQ ID NO: 71380 - protein, 15 aa, Homo sapiens
LPETHKFGEGVSSPK

SEQ ID NO: 71381 - protein, 27 aa, Homo sapiens
LPETHKFGEGVSSPKTHLGEALAPLSK

SEQ ID NO: 71382 - protein, 12 aa, Homo sapiens
MPDSGPLPETHK

SEQ ID NO: 71383 - protein, 21 aa, Homo sapiens
MPDSGPLPETHKFGEGVSSPK

SEQ ID NO: 71384 - protein, 33 aa, Homo sapiens
MPDSGPLPETHKFGEGVSSPKTHLGEALAPLSK

SEQ ID NO: 71385 - protein, 11 aa, Homo sapiens
NAPPEPVPPPR

SEQ ID NO: 71386 - protein, 17 aa, Homo sapiens
NSEPQDEGELFQGVDPR

SEQ ID NO: 71387 - protein, 25 aa, Homo sapiens
PPAPSGSQQGPEEEAAEALLTETVR

SEQ ID NO: 71388 - protein, 33 aa, Homo sapiens
RKEAEGTEEGGEEEDDEEMDPQTIDSLIELSTK

SEQ ID NO: 71389 - protein, 15 aa, Homo sapiens
RPESALLGGSEAGER

SEQ ID NO: 71390 - protein, 9 aa, Homo sapiens
SQEETPGHR

SEQ ID NO: 71391 - protein, 37 aa, Homo sapiens
SQTHSLPAPESPEPAAPPRPQTPENGPEASDPSEELE

SEQ ID NO: 71392 - protein, 38 aa, Homo sapiens
SQTHSLPAPESPEPAAPPRPQTPENGPEASDPSEELEA

SEQ ID NO: 71393 - protein, 12 aa, Homo sapiens
THLGEALAPLSK

SEQ ID NO: 71394 - protein, 23 aa, Homo sapiens
THLGEALAPLSKAYQGVAAPFPK

SEQ ID NO: 71395 - protein, 22 aa, Homo sapiens
VGEEDEEAAEAEAEAEEAERAR

SEQ ID NO: 71396 - protein, 18 aa, Homo sapiens
VPERAPLPPPAPSQFQAR

SEQ ID NO: 71397 - protein, 20 aa, Homo sapiens
VKEMHTCTVEGCNATFPSRR

SEQ ID NO: 71398 - protein, 34 aa, Homo sapiens
LSLSAETQDFAGESEVDEIEAALSNLEVTLEGGK

SEQ ID NO: 71399 - protein, 15 aa, Homo sapiens
SEELSLLKPSGDYFK

SEQ ID NO: 71400 - protein, 20 aa, Homo sapiens
RDGNGTVDFPEFLGMMARKM

SEQ ID NO: 71401 - protein, 20 aa, Homo sapiens
NTSAPPAVSPNITVLAPGKG

SEQ ID NO: 71402 - protein, 32 aa, Homo sapiens
MNGTELPPPPTFSLVQAGDKVVCLVLDVSSKM

SEQ ID NO: 71403 - protein, 18 aa, Homo sapiens
AHSPASTLPNSPGSTFER

SEQ ID NO: 71404 - protein, 10 aa, Homo sapiens
LLSTDASHSR

SEQ ID NO: 71405 - protein, 19 aa, Homo sapiens
RHAYEGSSSGNSSPEYPRK

SEQ ID NO: 71406 - protein, 30 aa, Homo sapiens
RRLSLSQSITDDDLEAIANDSEEEIIKPRS

SEQ ID NO: 71407 - protein, 22 aa, Homo sapiens
ACPCPHTNSFATGCVVNGGDVR

SEQ ID NO: 71408 - protein, 13 aa, Homo sapiens
KEVIDTNLTTLRD

SEQ ID NO: 71409 - protein, 22 aa, Homo sapiens
KIESINQQLLPLGNISDNMDRI

SEQ ID NO: 71410 - protein, 17 aa, Homo sapiens
LGGSNFEGCISNVFVQR

SEQ ID NO: 71411 - protein, 21 aa, Homo sapiens
TQANHGALQFGDIPTSHLLFK

SEQ ID NO: 71412 - protein, 21 aa, Homo sapiens
EQFEKISSADPSGAFRMLSTA

SEQ ID NO: 71413 - protein, 13 aa, Homo sapiens
LQGSCFCHGHADR

SEQ ID NO: 71414 - protein, 14 aa, Homo sapiens
CIHNTAGIYCDQCK

SEQ ID NO: 71415 - protein, 18 aa, Homo sapiens
GHLHLLETSIDGILADVK

SEQ ID NO: 71416 - protein, 15 aa, Homo sapiens
LQGVSDQSFQVEEAK

SEQ ID NO: 71417 - protein, 22 aa, Homo sapiens
RAQEALSMGNATFYEVESILKN

SEQ ID NO: 71418 - protein, 9 aa, Homo sapiens
ACLENLGLK

SEQ ID NO: 71419 - protein, 14 aa, Homo sapiens
DELNADHPFIYIIR

SEQ ID NO: 71420 - protein, 21 aa, Homo sapiens
DLTDGHFENILADNSVNDQTK

SEQ ID NO: 71421 - protein, 11 aa, Homo sapiens
DVEDESTGLEK

SEQ ID NO: 71422 - protein, 14 aa, Homo sapiens
DVEDESTGLEKIEK

SEQ ID NO: 71423 - protein, 25 aa, Homo sapiens
EPLGNVLFSPICLSTSLSLAQVGAK

SEQ ID NO: 71424 - protein, 17 aa, Homo sapiens
GDTANEIGQVLHFENVK

SEQ ID NO: 71425 - protein, 8 aa, Homo sapiens
GQINNSIK

SEQ ID NO: 71426 - protein, 10 aa, Homo sapiens
GVALSNVIHK

SEQ ID NO: 71427 - protein, 17 aa, Homo sapiens
HIFSEDTSDFSGMSETK

SEQ ID NO: 71428 - protein, 10 aa, Homo sapiens
HLSMFILLPK

SEQ ID NO: 71429 - protein, 19 aa, Homo sapiens
ILQHKDELNADHPFIYIIR

SEQ ID NO: 71430 - protein, 7 aa, Homo sapiens
NIIFFGK

SEQ ID NO: 71431 - protein, 13 aa, Homo sapiens
PFGFQTVTSDVNK

SEQ ID NO: 71432 - protein, 30 aa, Homo sapiens
QLCEKEPLGNVLFSPICLSTSLSLAQVGAK

SEQ ID NO: 71433 - protein, 20 aa, Homo sapiens
QLNSESLSQWTNPSTMANAK

SEQ ID NO: 71434 - protein, 13 aa, Homo sapiens
SLNLSTEFISSTK

SEQ ID NO: 71435 - protein, 19 aa, Homo sapiens
VCLEITEDGGDSIEVPGAR

SEQ ID NO: 71436 - protein, 20 aa, Homo sapiens
VLFSPICLSTSLSLAQVGAK

SEQ ID NO: 71437 - protein, 13 aa, Homo sapiens
DEISTTDAIFVQR

SEQ ID NO: 71438 - protein, 20 aa, Homo sapiens
EVPLSALTNILSAQLISHWK

SEQ ID NO: 71439 - protein, 23 aa, Homo sapiens
ALNFSVFHYEIANSPEEAISLAK

SEQ ID NO: 71440 - protein, 24 aa, Homo sapiens
DNLTLWTADNAGEEGGEAPQEPQS

SEQ ID NO: 71441 - protein, 21 aa, Homo sapiens
EKVETELQGVCDTVLGLLDSH

SEQ ID NO: 71442 - protein, 24 aa, Homo sapiens
EKVETELQGVCDTVLGLLDSHLIK

SEQ ID NO: 71443 - protein, 17 aa, Homo sapiens
FDEAMADLHTLSEDSYK

SEQ ID NO: 71444 - protein, 20 aa, Homo sapiens
FSVFHYEIANSPEEAISLAK

SEQ ID NO: 71445 - protein, 16 aa, Homo sapiens
GVCDTVLGLLDSHLIK

SEQ ID NO: 71446 - protein, 16 aa, Homo sapiens
HYEIANSPEEAISLAK

SEQ ID NO: 71447 - protein, 26 aa, Homo sapiens
LGLALNFSVFHYEIANSPEEAISLAK

SEQ ID NO: 71448 - protein, 21 aa, Homo sapiens
NFSVFHYEIANSPEEAISLAK

SEQ ID NO: 71449 - protein, 11 aa, Homo sapiens
SAYQEAMDISK

SEQ ID NO: 71450 - protein, 14 aa, Homo sapiens
SNEEGSEEKGPEVR

SEQ ID NO: 71451 - protein, 19 aa, Homo sapiens
SVFHYEIANSPEEAISLAK

SEQ ID NO: 71452 - protein, 20 aa, Homo sapiens
TELQGVCDTVLGLLDSHLIK

SEQ ID NO: 71453 - protein, 19 aa, Homo sapiens
TTFDEAMADLHTLSEDSYK

SEQ ID NO: 71454 - protein, 19 aa, Homo sapiens
VETELQGVCDTVLGLLDSH

SEQ ID NO: 71455 - protein, 22 aa, Homo sapiens
VETELQGVCDTVLGLLDSHLIK

SEQ ID NO: 71456 - protein, 8 aa, Homo sapiens
VLSSIEQK

SEQ ID NO: 71457 - protein, 9 aa, Homo sapiens
YEDMAAFMK

SEQ ID NO: 71458 - protein, 11 aa, Homo sapiens
YLAEVATGDDK

SEQ ID NO: 71459 - protein, 13 aa, Homo sapiens
YLAEVATGDDKKR

SEQ ID NO: 71460 - protein, 27 aa, Homo sapiens
RSLIASGLYGYNATLVGVLMAVFSDKG

SEQ ID NO: 71461 - protein, 15 aa, Homo sapiens
RNASVQDSTNTPLGS

SEQ ID NO: 71462 - protein, 19 aa, Homo sapiens
MCLNTSDLQCLNKDSLEKW

SEQ ID NO: 71463 - protein, 20 aa, Homo sapiens
AGTLDNISVTLVGTCGESPK

SEQ ID NO: 71464 - protein, 22 aa, Homo sapiens
DIQERNQGLALPYTYLDPPLIE

SEQ ID NO: 71465 - protein, 10 aa, Homo sapiens
YTLQVNTIAR

SEQ ID NO: 71466 - protein, 10 aa, Homo sapiens
RRLSLNQSRG

SEQ ID NO: 71467 - protein, 23 aa, Homo sapiens
KKNSDGMEAAGVQIQMVNESLGY

SEQ ID NO: 71468 - protein, 17 aa, Homo sapiens
RASVSFLNFNLSNCERK

SEQ ID NO: 71469 - protein, 17 aa, Homo sapiens
LLVAQTSSPHSGHKPQK

SEQ ID NO: 71470 - protein, 22 aa, Homo sapiens
SSLNSSSSGDQDYDYLNDWGPR

SEQ ID NO: 71471 - protein, 36 aa, Homo sapiens
VYNGSVDEGSKPGTYVMTVTANDADDSTTANGMVRY

SEQ ID NO: 71472 - protein, 18 aa, Homo sapiens
SLPGQNEDLVLTGYQVDK

SEQ ID NO: 71473 - protein, 12 aa, Homo sapiens
TQVVAGTNYYIK

SEQ ID NO: 71474 - protein, 11 aa, Homo sapiens
DAVEDLESVGK

SEQ ID NO: 71475 - protein, 11 aa, Homo sapiens
ENAGEDPGLAR

SEQ ID NO: 71476 - protein, 14 aa, Homo sapiens
GAVHDVKDVLDSVL

SEQ ID NO: 71477 - protein, 14 aa, Homo sapiens
LGKDAVEDLESVGK

SEQ ID NO: 71478 - protein, 14 aa, Homo sapiens
IEDDNDNAPYFEHR

SEQ ID NO: 71479 - protein, 19 aa, Homo sapiens
ILEDGSIYTTHDLILSSER

SEQ ID NO: 71480 - protein, 10 aa, Homo sapiens
ILQQIPDHPK

SEQ ID NO: 71481 - protein, 12 aa, Homo sapiens
PSHLQAETLVGK

SEQ ID NO: 71482 - protein, 27 aa, Homo sapiens
RSKRRWAPIPASLMENSLGPFPQHVQQ

SEQ ID NO: 71483 - protein, 11 aa, Homo sapiens
SFSIFLSDGQR

SEQ ID NO: 71484 - protein, 13 aa, Homo sapiens
VPSHLQAETLVGK

SEQ ID NO: 71485 - protein, 13 aa, Homo sapiens
VQDQDLPNTPHSK

SEQ ID NO: 71486 - protein, 15 aa, Homo sapiens
VTATDLDEPDTLHTR

SEQ ID NO: 71487 - protein, 16 aa, Homo sapiens
DLDEGPECTPAAQYVR

SEQ ID NO: 71488 - protein, 10 aa, Homo sapiens
EVTVLLEHQK

SEQ ID NO: 71489 - protein, 33 aa, Homo sapiens
MTQTTNNSSQGFCGTMGSGMKNGGQETIEMMKG

SEQ ID NO: 71490 - protein, 9 aa, Homo sapiens
SFTIWLSDK

SEQ ID NO: 71491 - protein, 25 aa, Homo sapiens
VEDENDNHPVFTEAIYNFEVLESSR

SEQ ID NO: 71492 - protein, 17 aa, Homo sapiens
VILNVPSKLEADKIIGR

SEQ ID NO: 71493 - protein, 11 aa, Homo sapiens
VLNDGSVYTAR

SEQ ID NO: 71494 - protein, 13 aa, Homo sapiens
VNLCECTHPTQCR

SEQ ID NO: 71495 - protein, 8 aa, Homo sapiens
VNLEECFR

SEQ ID NO: 71496 - protein, 11 aa, Homo sapiens
EQYGQYALAVR

SEQ ID NO: 71497 - protein, 19 aa, Homo sapiens
ISGVGIDQPPYGIFVINQK

SEQ ID NO: 71498 - protein, 36 aa, Homo sapiens
MATFAGQIEENSNANTLVMILNATDADEPNNLNSKI

SEQ ID NO: 71499 - protein, 25 aa, Homo sapiens
MRSSSDHHFNQTIGSASPSTARSRI

SEQ ID NO: 71500 - protein, 13 aa, Homo sapiens
VGDFVATDLDTGR

SEQ ID NO: 71501 - protein, 19 aa, Homo sapiens
VGDFVATDLDTGRPSTTVR

SEQ ID NO: 71502 - protein, 14 aa, Homo sapiens
YQGTILSIDDNLQR

SEQ ID NO: 71503 - protein, 16 aa, Homo sapiens
YVMGNNPADLLAVDSR

SEQ ID NO: 71504 - protein, 18 aa, Homo sapiens
ALNAQGLDVEKPLILTVK

SEQ ID NO: 71505 - protein, 23 aa, Homo sapiens
AQEQIPPGVYHISLVLTDSQNNR

SEQ ID NO: 71506 - protein, 15 aa, Homo sapiens
DAVCSSSPSVVVSAR

SEQ ID NO: 71507 - protein, 19 aa, Homo sapiens
DSGYGIESCGHPIEVQQTG

SEQ ID NO: 71508 - protein, 22 aa, Homo sapiens
DSGYGIESCGHPIEVQQTGFVK

SEQ ID NO: 71509 - protein, 8 aa, Homo sapiens
HSTGGTNK

SEQ ID NO: 71510 - protein, 18 aa, Homo sapiens
LVDYILGTYQAIDEDTNK

SEQ ID NO: 71511 - protein, 22 aa, Homo sapiens
LVVSGADKDGEGLSTQCECNIK

SEQ ID NO: 71512 - protein, 15 aa, Homo sapiens
VPDFNDNCPTAVLEK

SEQ ID NO: 71513 - protein, 17 aa, Homo sapiens
HGSYGSADYDYGESGFR

SEQ ID NO: 71514 - protein, 13 aa, Homo sapiens
HSQVGQGESAGSK

SEQ ID NO: 71515 - protein, 10 aa, Homo sapiens
LAQAYYESTR

SEQ ID NO: 71516 - protein, 21 aa, Homo sapiens
RSRHENTSQVPLQESRTRKRR

SEQ ID NO: 71517 - protein, 15 aa, Homo sapiens
FLVDSGAQVSVVHPN

SEQ ID NO: 71518 - protein, 13 aa, Homo sapiens
ILGVWDTAVSLGK

SEQ ID NO: 71519 - protein, 20 aa, Homo sapiens
ALLFLVFNENESWYLDDNIK

SEQ ID NO: 71520 - protein, 17 aa, Homo sapiens
FLVFNENESWYLDDNIK

SEQ ID NO: 71521 - protein, 24 aa, Homo sapiens
RGERHGDIFMNRTENWIGSQYKKV

SEQ ID NO: 71522 - protein, 10 aa, Homo sapiens
DLLPHPVLGR

SEQ ID NO: 71523 - protein, 18 aa, Homo sapiens
ALEHVDGTHVCQLPEDQK

SEQ ID NO: 71524 - protein, 30 aa, Homo sapiens
CHCHQQSLYTDTICEINYSAIHPGLCEDLR

SEQ ID NO: 71525 - protein, 13 aa, Homo sapiens
CHLDTTGTYTQYR

SEQ ID NO: 71526 - protein, 36 aa, Homo sapiens
DIGWRPDSTHLLVFSTESAFHYEADGANVLAGIMSR

SEQ ID NO: 71527 - protein, 14 aa, Homo sapiens
DVVSFEQPEFSVSR

SEQ ID NO: 71528 - protein, 18 aa, Homo sapiens
DYIPVEGELLFQPGEAWK

SEQ ID NO: 71529 - protein, 21 aa, Homo sapiens
EAPHGPPDDGGAGGKGGSLPR

SEQ ID NO: 71530 - protein, 24 aa, Homo sapiens
EGVITIESQVHPQSPLCPLPGSAF

SEQ ID NO: 71531 - protein, 15 aa, Homo sapiens
ENLMASDHLDTPMLR

SEQ ID NO: 71532 - protein, 16 aa, Homo sapiens
FGAHLGQPHSTTIIIR

SEQ ID NO: 71533 - protein, 23 aa, Homo sapiens
FGAHLGQPHSTTIIIRDPDELDR

SEQ ID NO: 71534 - protein, 9 aa, Homo sapiens
FHVQLSNPK

SEQ ID NO: 71535 - protein, 15 aa, Homo sapiens
GECQCGHCVCYGEGR

SEQ ID NO: 71536 - protein, 14 aa, Homo sapiens
GNIHLKPSFSDGLK

SEQ ID NO: 71537 - protein, 20 aa, Homo sapiens
GQTCNCSTGSLSDIQPCLRE

SEQ ID NO: 71538 - protein, 9 aa, Homo sapiens
HVTQEFVSR

SEQ ID NO: 71539 - protein, 11 aa, Homo sapiens
IHFNWLPPSGK

SEQ ID NO: 71540 - protein, 23 aa, Homo sapiens
ISGNLDAPEGGFDAILQTAVCTR

SEQ ID NO: 71541 - protein, 15 aa, Homo sapiens
KQDHTIVDTVLMAPR

SEQ ID NO: 71542 - protein, 12 aa, Homo sapiens
LCTENLLKPDTR

SEQ ID NO: 71543 - protein, 30 aa, Homo sapiens
LHTYFPVSSLGVLQEDSSNIVELLEEAFNR

SEQ ID NO: 71544 - protein, 15 aa, Homo sapiens
LKEPWPNSDPPFSFK

SEQ ID NO: 71545 - protein, 25 aa, Homo sapiens
LNIPNPAQTSVVVEDLLPNHSYVFR

SEQ ID NO: 71546 - protein, 11 aa, Homo sapiens
LTAGVPDTPTR

SEQ ID NO: 71547 - protein, 20 aa, Homo sapiens
MTTTSAAAYGTHLSPHVPHR

SEQ ID NO: 71548 - protein, 23 aa, Homo sapiens
PGFATHAASINPTELVPYGLSLR

SEQ ID NO: 71549 - protein, 31 aa, Homo sapiens
RDEDDDCTYSYTMEGDGAPGPNSTVLVHKKK

SEQ ID NO: 71550 - protein, 12 aa, Homo sapiens
RGEVGIYQVQLR

SEQ ID NO: 71551 - protein, 34 aa, Homo sapiens
RPMSIPIIPDIPIVDAQSGEDYDSFLMYSDDVLR

SEQ ID NO: 71552 - protein, 26 aa, Homo sapiens
RPNGDIVGYLVTCEMAQGGGPATAFR

SEQ ID NO: 71553 - protein, 13 aa, Homo sapiens
SCVQCQAWGTGEK

SEQ ID NO: 71554 - protein, 11 aa, Homo sapiens
SEHSHSTTLPR

SEQ ID NO: 71555 - protein, 18 aa, Homo sapiens
SQPPPHGDLGAPQNPNAK

SEQ ID NO: 71556 - protein, 9 aa, Homo sapiens
TSGFLCNDR

SEQ ID NO: 71557 - protein, 19 aa, Homo sapiens
VCAYGAQGEGPYSSLVSCR

SEQ ID NO: 71558 - protein, 13 aa, Homo sapiens
VPLFIRPEDDDEK

SEQ ID NO: 71559 - protein, 31 aa, Homo sapiens
VPLFIRPEDDDEKQLLVEAIDVPAGTATLGR

SEQ ID NO: 71560 - protein, 12 aa, Homo sapiens
VSVPQTDMRPEK

SEQ ID NO: 71561 - protein, 15 aa, Homo sapiens
YEGQFCEYDNFQCPR

SEQ ID NO: 71562 - protein, 17 aa, Homo sapiens
YWIQGDSESEAHLLDSK

SEQ ID NO: 71563 - protein, 21 aa, Homo sapiens
SPSGSQRPSVSDDTEHLVNGR

SEQ ID NO: 71564 - protein, 30 aa, Homo sapiens
HLEQQEGQLEHLEHQEGQLGLPEQQVLQLK

SEQ ID NO: 71565 - protein, 10 aa, Homo sapiens
HLEQQEGQLK

SEQ ID NO: 71566 - protein, 20 aa, Homo sapiens
HLEQQQGQLEVPEQQVGQPK

SEQ ID NO: 71567 - protein, 12 aa, Homo sapiens
VPVELPVEVPSK

SEQ ID NO: 71568 - protein, 10 aa, Homo sapiens
YLEQQEGQLK

SEQ ID NO: 71569 - protein, 12 aa, Homo sapiens
VQISQLHQEIQR

SEQ ID NO: 71570 - protein, 12 aa, Homo sapiens
YLDFSSIITEVR

SEQ ID NO: 71571 - protein, 20 aa, Homo sapiens
GSLASYCAAGRGAGAGFGSR

SEQ ID NO: 71572 - protein, 19 aa, Homo sapiens
KDVRPINVSSHCPSAGTKC

SEQ ID NO: 71573 - protein, 12 aa, Homo sapiens
SDKPGVYTNICR

SEQ ID NO: 71574 - protein, 16 aa, Homo sapiens
VKPISLADHCTQPGQK

SEQ ID NO: 71575 - protein, 10 aa, Homo sapiens
AEAESLYQSK

SEQ ID NO: 71576 - protein, 20 aa, Homo sapiens
AEAESLYQSKYEELQITAGR

SEQ ID NO: 71577 - protein, 9 aa, Homo sapiens
AQYEDIAQK

SEQ ID NO: 71578 - protein, 9 aa, Homo sapiens
DVDGAYMTK

SEQ ID NO: 71579 - protein, 9 aa, Homo sapiens
DYQELMNTK

SEQ ID NO: 71580 - protein, 31 aa, Homo sapiens
EESRMSGECAPNVSVSVSTSHTTISGGGSRG

SEQ ID NO: 71581 - protein, 20 aa, Homo sapiens
EREQIKSLNNQFASFIDKVR

SEQ ID NO: 71582 - protein, 9 aa, Homo sapiens
FESFINNLR

SEQ ID NO: 71583 - protein, 12 aa, Homo sapiens
FLEQQNQVLQTK

SEQ ID NO: 71584 - protein, 24 aa, Homo sapiens
FLEQQNQVLQTKWELLQQVDTSTR

SEQ ID NO: 71585 - protein, 20 aa, Homo sapiens
FSSCGGGGGSFGAGGGFGSR

SEQ ID NO: 71586 - protein, 11 aa, Homo sapiens
FVSTTYSGVTR

SEQ ID NO: 71587 - protein, 9 aa, Homo sapiens
GENALKDAK

SEQ ID NO: 71588 - protein, 31 aa, Homo sapiens
GGGGGGYGSGGSSYGSGGGSYGSGGGGGGGR

SEQ ID NO: 71589 - protein, 28 aa, Homo sapiens
GGSGGGGGGSSGGRGSGGGSSGGSIGGR

SEQ ID NO: 71590 - protein, 26 aa, Homo sapiens
GGSYGSGGGGGGHGSYGSGSSSGGYR

SEQ ID NO: 71591 - protein, 18 aa, Homo sapiens
GSGFGGGYGGGGFGGGGF

SEQ ID NO: 71592 - protein, 14 aa, Homo sapiens
GSGGGSSGGSIGGR

SEQ ID NO: 71593 - protein, 39 aa, Homo sapiens
GSYGSGGSSYGSGGGSYGSGGGGGGHGSYGSGSSSGGYR

SEQ ID NO: 71594 - protein, 8 aa, Homo sapiens
IEISELNR

SEQ ID NO: 71595 - protein, 12 aa, Homo sapiens
IEISELNRVIQR

SEQ ID NO: 71596 - protein, 19 aa, Homo sapiens
INQSLLQPLNVEIDPEIQK

SEQ ID NO: 71597 - protein, 14 aa, Homo sapiens
ISETNVILSMDNNR

SEQ ID NO: 71598 - protein, 16 aa, Homo sapiens
KQISNLQQSISDAEQR

SEQ ID NO: 71599 - protein, 11 aa, Homo sapiens
LALDLEIATYR

SEQ ID NO: 71600 - protein, 15 aa, Homo sapiens
LDNLQQEIDFLTALY

SEQ ID NO: 71601 - protein, 39 aa, Homo sapiens
LDNLQQEIDFLTALYQAELSQMQTQISETNVILSMDNNR

SEQ ID NO: 71602 - protein, 6 aa, Homo sapiens
LDSELK

SEQ ID NO: 71603 - protein, 16 aa, Homo sapiens
LDSELKNMQDMVEDYR

SEQ ID NO: 71604 - protein, 11 aa, Homo sapiens
LEQQNQVLQTK

SEQ ID NO: 71605 - protein, 15 aa, Homo sapiens
LLQPLNVEIDPEIQK

SEQ ID NO: 71606 - protein, 12 aa, Homo sapiens
LLRDYQELMNTK

SEQ ID NO: 71607 - protein, 12 aa, Homo sapiens
LNDLEDALQQAK

SEQ ID NO: 71608 - protein, 17 aa, Homo sapiens
LNDLEDALQQAKEDLAR

SEQ ID NO: 71609 - protein, 11 aa, Homo sapiens
LQQSISDAEQR

SEQ ID NO: 71610 - protein, 9 aa, Homo sapiens
LRSEIDNVK

SEQ ID NO: 71611 - protein, 10 aa, Homo sapiens
LRSEIDNVKK

SEQ ID NO: 71612 - protein, 25 aa, Homo sapiens
LRSEIDNVKKQISNLQQSISDAEQR

SEQ ID NO: 71613 - protein, 14 aa, Homo sapiens
NKLNDLEDALQQAK

SEQ ID NO: 71614 - protein, 19 aa, Homo sapiens
NKLNDLEDALQQAKEDLAR

SEQ ID NO: 71615 - protein, 10 aa, Homo sapiens
NMQDMVEDYR

SEQ ID NO: 71616 - protein, 11 aa, Homo sapiens
NSKIEISELNR

SEQ ID NO: 71617 - protein, 11 aa, Homo sapiens
PYFESFINNLR

SEQ ID NO: 71618 - protein, 15 aa, Homo sapiens
QISNLQQSISDAEQR

SEQ ID NO: 71619 - protein, 21 aa, Homo sapiens
QISNLQQSISDAEQRGENALK

SEQ ID NO: 71620 - protein, 24 aa, Homo sapiens
QISNLQQSISDAEQRGENALKDAK

SEQ ID NO: 71621 - protein, 13 aa, Homo sapiens
QPLNVEIDPEIQK

SEQ ID NO: 71622 - protein, 17 aa, Homo sapiens
QSLLQPLNVEIDPEIQK

SEQ ID NO: 71623 - protein, 27 aa, Homo sapiens
RMSGECAPNVSVSVSTSHTTISGGGSR

SEQ ID NO: 71624 - protein, 13 aa, Homo sapiens
RTNAENEFVTIKK

SEQ ID NO: 71625 - protein, 11 aa, Homo sapiens
RVDQLKSDQSR

SEQ ID NO: 71626 - protein, 15 aa, Homo sapiens
SGGGFSSGSAGIINY

SEQ ID NO: 71627 - protein, 17 aa, Homo sapiens
SGGGFSSGSAGIINYQR

SEQ ID NO: 71628 - protein, 22 aa, Homo sapiens
SGYRSGGGFSSGSAGIINYQRR

SEQ ID NO: 71629 - protein, 8 aa, Homo sapiens
SISISVAR

SEQ ID NO: 71630 - protein, 12 aa, Homo sapiens
SKAEAESLYQSK

SEQ ID NO: 71631 - protein, 22 aa, Homo sapiens
SKAEAESLYQSKYEELQITAGR

SEQ ID NO: 71632 - protein, 12 aa, Homo sapiens
SLDLDSIIAEVK

SEQ ID NO: 71633 - protein, 21 aa, Homo sapiens
SLDLDSIIAEVKAQYEDIAQK

SEQ ID NO: 71634 - protein, 16 aa, Homo sapiens
SLLQPLNVEIDPEIQK

SEQ ID NO: 71635 - protein, 12 aa, Homo sapiens
SLNNQFASFIDK

SEQ ID NO: 71636 - protein, 14 aa, Homo sapiens
SLNNQFASFIDKVR

SEQ ID NO: 71637 - protein, 9 aa, Homo sapiens
SLVNLGGSK

SEQ ID NO: 71638 - protein, 17 aa, Homo sapiens
SLVNLGGSKSISISVAR

SEQ ID NO: 71639 - protein, 9 aa, Homo sapiens
SSGGSSSVR

SEQ ID NO: 71640 - protein, 12 aa, Homo sapiens
SSGSAGIINYQR

SEQ ID NO: 71641 - protein, 32 aa, Homo sapiens
SSYGSGGGSYGSGGGGGGHGSYGSGSSSGGYR

SEQ ID NO: 71642 - protein, 11 aa, Homo sapiens
THNLEPYFESF

SEQ ID NO: 71643 - protein, 13 aa, Homo sapiens
THNLEPYFESFIN

SEQ ID NO: 71644 - protein, 16 aa, Homo sapiens
THNLEPYFESFINNLR

SEQ ID NO: 71645 - protein, 17 aa, Homo sapiens
THNLEPYFESFINNLRR

SEQ ID NO: 71646 - protein, 20 aa, Homo sapiens
TINQSLLQPLNVEIDPEIQK

SEQ ID NO: 71647 - protein, 9 aa, Homo sapiens
TLLEGEESR

SEQ ID NO: 71648 - protein, 11 aa, Homo sapiens
TNAENEFVTIK

SEQ ID NO: 71649 - protein, 12 aa, Homo sapiens
TNAENEFVTIKK

SEQ ID NO: 71650 - protein, 6 aa, Homo sapiens
VDLQAK

SEQ ID NO: 71651 - protein, 10 aa, Homo sapiens
VDQLKSDQSR

SEQ ID NO: 71652 - protein, 14 aa, Homo sapiens
VSTSHTTISGGGSR

SEQ ID NO: 71653 - protein, 16 aa, Homo sapiens
VSVSTSHTTISGGGSR

SEQ ID NO: 71654 - protein, 18 aa, Homo sapiens
VSVSVSTSHTTISGGGSR

SEQ ID NO: 71655 - protein, 12 aa, Homo sapiens
WELLQQVDTSTR

SEQ ID NO: 71656 - protein, 10 aa, Homo sapiens
YEELQITAGR

SEQ ID NO: 71657 - protein, 18 aa, Homo sapiens
ADLEMQIESLTEELAYLK

SEQ ID NO: 71658 - protein, 19 aa, Homo sapiens
ADLEMQIESLTEELAYLKK

SEQ ID NO: 71659 - protein, 17 aa, Homo sapiens
AETECQNTEYQQLLDIK

SEQ ID NO: 71660 - protein, 10 aa, Homo sapiens
ALEEQLQQIR

SEQ ID NO: 71661 - protein, 12 aa, Homo sapiens
ALEESNYELEGK

SEQ ID NO: 71662 - protein, 14 aa, Homo sapiens
AQISALEEQLQQIR

SEQ ID NO: 71663 - protein, 9 aa, Homo sapiens
DAEAWFNEK

SEQ ID NO: 71664 - protein, 7 aa, Homo sapiens
DELTLTK

SEQ ID NO: 71665 - protein, 34 aa, Homo sapiens
DYSKYYKTIDDLKNQILNLTTDNANILLQIDNAR

SEQ ID NO: 71666 - protein, 11 aa, Homo sapiens
EIELQSQLALK

SEQ ID NO: 71667 - protein, 17 aa, Homo sapiens
ELTTEIDNNIEQISSYK

SEQ ID NO: 71668 - protein, 25 aa, Homo sapiens
ELTTEIDNNIEQISSYKSEITELRR

SEQ ID NO: 71669 - protein, 41 aa, Homo sapiens
GFSSGGFSGGSFSRGSSGGGCFGGSSGGYGGLGGFGGGSFR

SEQ ID NO: 71670 - protein, 20 aa, Homo sapiens
GGGFGGGFGGDGGLLSGNEK

SEQ ID NO: 71671 - protein, 16 aa, Homo sapiens
GGGFSSGGFSGGSFSR

SEQ ID NO: 71672 - protein, 25 aa, Homo sapiens
GGGGFGGGFGGGFGGDGGLLSGNEK

SEQ ID NO: 71673 - protein, 30 aa, Homo sapiens
GGGGFGGGGFGGGFGGGFGGDGGLLSGNEK

SEQ ID NO: 71674 - protein, 35 aa, Homo sapiens
GGGSFGGGGFGGGGFGGGFGGGFGGDGGLLSGNEK

SEQ ID NO: 71675 - protein, 12 aa, Homo sapiens
GGLGGFGGGSFR

SEQ ID NO: 71676 - protein, 19 aa, Homo sapiens
GGSSGGYGGLGGFGGGSFR

SEQ ID NO: 71677 - protein, 45 aa, Homo sapiens
GGSSSGGYGGGSSGGGGGGYGGGSSGGGSSSGGGYGGGSSSGGHK

SEQ ID NO: 71678 - protein, 12 aa, Homo sapiens
GSLGGGFSSGGF

SEQ ID NO: 71679 - protein, 17 aa, Homo sapiens
GSLGGGFSSGGFSGGSF

SEQ ID NO: 71680 - protein, 18 aa, Homo sapiens
GSLGGGFSSGGFSGGSFS

SEQ ID NO: 71681 - protein, 19 aa, Homo sapiens
GSLGGGFSSGGFSGGSFSR

SEQ ID NO: 71682 - protein, 27 aa, Homo sapiens
GSSGGGCFGGSSGGYGGLGGFGGGSFR

SEQ ID NO: 71683 - protein, 16 aa, Homo sapiens
GSYGSSSFGGSYGGSF

SEQ ID NO: 71684 - protein, 21 aa, Homo sapiens
GSYGSSSFGGSYGGSFGGGSF

SEQ ID NO: 71685 - protein, 26 aa, Homo sapiens
GSYGSSSFGGSYGGSFGGGSFGGGSF

SEQ ID NO: 71686 - protein, 10 aa, Homo sapiens
HGNSHQGEPR

SEQ ID NO: 71687 - protein, 7 aa, Homo sapiens
IKEWYEK

SEQ ID NO: 71688 - protein, 16 aa, Homo sapiens
IQAQISALEEQLQQIR

SEQ ID NO: 71689 - protein, 11 aa, Homo sapiens
IRLENEIQTYR

SEQ ID NO: 71690 - protein, 12 aa, Homo sapiens
ISALEEQLQQIR

SEQ ID NO: 71691 - protein, 24 aa, Homo sapiens
ISSSKGSLGGGFSSGGFSGGSFSR

SEQ ID NO: 71692 - protein, 10 aa, Homo sapiens
KDAEAWFNEK

SEQ ID NO: 71693 - protein, 23 aa, Homo sapiens
KNQILNLTTDNANILLQIDNARL

SEQ ID NO: 71694 - protein, 9 aa, Homo sapiens
LENEIQTYR

SEQ ID NO: 71695 - protein, 10 aa, Homo sapiens
LKYENEVALR

SEQ ID NO: 71696 - protein, 16 aa, Homo sapiens
LTTDNANILLQIDNAR

SEQ ID NO: 71697 - protein, 10 aa, Homo sapiens
NHEEEMKDLR

SEQ ID NO: 71698 - protein, 12 aa, Homo sapiens
NQILNLTTDNAN

SEQ ID NO: 71699 - protein, 21 aa, Homo sapiens
NQILNLTTDNANILLQIDNAR

SEQ ID NO: 71700 - protein, 16 aa, Homo sapiens
NVQALEIELQSQLALK

SEQ ID NO: 71701 - protein, 12 aa, Homo sapiens
NVSTGDVNVEMN

SEQ ID NO: 71702 - protein, 26 aa, Homo sapiens
NVSTGDVNVEMNAAPGVDLTQLLNNM

SEQ ID NO: 71703 - protein, 27 aa, Homo sapiens
NVSTGDVNVEMNAAPGVDLTQLLNNMR

SEQ ID NO: 71704 - protein, 14 aa, Homo sapiens
QALEIELQSQLALK

SEQ ID NO: 71705 - protein, 13 aa, Homo sapiens
QSLEASLAETEGR

SEQ ID NO: 71706 - protein, 29 aa, Homo sapiens
RNVSTGDVNVEMNAAPGVDLTQLLNNMRS

SEQ ID NO: 71707 - protein, 8 aa, Homo sapiens
SEITELRR

SEQ ID NO: 71708 - protein, 20 aa, Homo sapiens
SGGGGGGGGCGGGGGVSSLR

SEQ ID NO: 71709 - protein, 16 aa, Homo sapiens
SGGYGGLGGFGGGSFR

SEQ ID NO: 71710 - protein, 19 aa, Homo sapiens
SKELTTEIDNNIEQISSYK

SEQ ID NO: 71711 - protein, 27 aa, Homo sapiens
SKELTTEIDNNIEQISSYKSEITELRR

SEQ ID NO: 71712 - protein, 18 aa, Homo sapiens
SLGGGFSSGGFSGGSFSR

SEQ ID NO: 71713 - protein, 14 aa, Homo sapiens
SLLEGEGSSGGGGR

SEQ ID NO: 71714 - protein, 23 aa, Homo sapiens
SLLEGEGSSGGGGRGGGSFGGGY

SEQ ID NO: 71715 - protein, 41 aa, Homo sapiens
SLLEGEGSSGGGGRGGGSFGGGYGGGSSGGGSSGGGYGGGH

SEQ ID NO: 71716 - protein, 11 aa, Homo sapiens
SQYEQLAEQNR

SEQ ID NO: 71717 - protein, 12 aa, Homo sapiens
SQYEQLAEQNRK

SEQ ID NO: 71718 - protein, 21 aa, Homo sapiens
SQYEQLAEQNRKDAEAWFNEK

SEQ ID NO: 71719 - protein, 12 aa, Homo sapiens
SSGGFSGGSFSR

SEQ ID NO: 71720 - protein, 23 aa, Homo sapiens
SSSKGSLGGGFSSGGFSGGSFSR

SEQ ID NO: 71721 - protein, 15 aa, Homo sapiens
SSSSGSVGESSSKGP

SEQ ID NO: 71722 - protein, 16 aa, Homo sapiens
SSSSGSVGESSSKGPR

SEQ ID NO: 71723 - protein, 18 aa, Homo sapiens
TIDDLKNQILNLTTDNAN

SEQ ID NO: 71724 - protein, 27 aa, Homo sapiens
TIDDLKNQILNLTTDNANILLQIDNAR

SEQ ID NO: 71725 - protein, 9 aa, Homo sapiens
VLDELTLTK

SEQ ID NO: 71726 - protein, 23 aa, Homo sapiens
YCVQLSQIQAQISALEEQLQQIR

SEQ ID NO: 71727 - protein, 8 aa, Homo sapiens
YENEVALR

SEQ ID NO: 71728 - protein, 11 aa, Homo sapiens
CEMEAQNQEYK

SEQ ID NO: 71729 - protein, 9 aa, Homo sapiens
DVEAWFFSK

SEQ ID NO: 71730 - protein, 30 aa, Homo sapiens
EASSGGGGSSSNFHINVEESVDGQVVSSHK

SEQ ID NO: 71731 - protein, 13 aa, Homo sapiens
EVASNTEMIQTSK

SEQ ID NO: 71732 - protein, 23 aa, Homo sapiens
GGSLLAGGGGFGGGSLSGGGGSR

SEQ ID NO: 71733 - protein, 7 aa, Homo sapiens
IHDWYQK

SEQ ID NO: 71734 - protein, 18 aa, Homo sapiens
TDLEMQIEGLNEELAYLK

SEQ ID NO: 71735 - protein, 19 aa, Homo sapiens
TDLEMQIEGLNEELAYLKK

SEQ ID NO: 71736 - protein, 41 aa, Homo sapiens
VCGFGGGAGSVFGGGFGGGVGGGFGGGFGGGDGGLLSGNEK

SEQ ID NO: 71737 - protein, 23 aa, Homo sapiens
YATQLQQIQGLIGGLEAQLSELR

SEQ ID NO: 71738 - protein, 14 aa, Homo sapiens
APSTYGGGLSVSSR

SEQ ID NO: 71739 - protein, 9 aa, Homo sapiens
DAETWFLSK

SEQ ID NO: 71740 - protein, 28 aa, Homo sapiens
DAETWFLSKTEELNKEVASNSELVQSSR

SEQ ID NO: 71741 - protein, 13 aa, Homo sapiens
EVASNSELVQSSR

SEQ ID NO: 71742 - protein, 24 aa, Homo sapiens
GGGLGAGFGGGFAGGDGLLVGSEK

SEQ ID NO: 71743 - protein, 21 aa, Homo sapiens
GQTGGDVNVEMDAAPGVDLSR

SEQ ID NO: 71744 - protein, 19 aa, Homo sapiens
IIAATIENAQPILQIDNAR

SEQ ID NO: 71745 - protein, 18 aa, Homo sapiens
LLEGEDAHLSSQQASGQS

SEQ ID NO: 71746 - protein, 19 aa, Homo sapiens
LLEGEDAHLSSQQASGQSY

SEQ ID NO: 71747 - protein, 22 aa, Homo sapiens
LLEGEDAHLSSQQASGQSYSSR

SEQ ID NO: 71748 - protein, 10 aa, Homo sapiens
NHEEEMLALR

SEQ ID NO: 71749 - protein, 21 aa, Homo sapiens
NKIIAATIENAQPILQIDNAR

SEQ ID NO: 71750 - protein, 11 aa, Homo sapiens
QTVEADVNGLR

SEQ ID NO: 71751 - protein, 8 aa, Homo sapiens
SEVTELRR

SEQ ID NO: 71752 - protein, 18 aa, Homo sapiens
SQIQGLIGSVEEQLAQLR

SEQ ID NO: 71753 - protein, 11 aa, Homo sapiens
TDLEMQIEGLK

SEQ ID NO: 71754 - protein, 18 aa, Homo sapiens
TDLEMQIEGLKEELAYLR

SEQ ID NO: 71755 - protein, 19 aa, Homo sapiens
TEELNKEVASNSELVQSSR

SEQ ID NO: 71756 - protein, 10 aa, Homo sapiens
TKYEHELALR

SEQ ID NO: 71757 - protein, 16 aa, Homo sapiens
VLQGLEIELQSQLSMK

SEQ ID NO: 71758 - protein, 23 aa, Homo sapiens
YCMQLSQIQGLIGSVEEQLAQLR

SEQ ID NO: 71759 - protein, 11 aa, Homo sapiens
ADLEMQIENLK

SEQ ID NO: 71760 - protein, 18 aa, Homo sapiens
ADLEMQIENLKEELAYLK

SEQ ID NO: 71761 - protein, 19 aa, Homo sapiens
ADLEMQIENLKEELAYLKK

SEQ ID NO: 71762 - protein, 12 aa, Homo sapiens
ALEEANTELEVK

SEQ ID NO: 71763 - protein, 13 aa, Homo sapiens
ASLEGNLAETENR

SEQ ID NO: 71764 - protein, 9 aa, Homo sapiens
DAEDWFFSK

SEQ ID NO: 71765 - protein, 7 aa, Homo sapiens
DYSQYYR

SEQ ID NO: 71766 - protein, 33 aa, Homo sapiens
GGSSYSSCYSFGSGGGYGSSFGGVDGLLAGGEK

SEQ ID NO: 71767 - protein, 21 aa, Homo sapiens
GQVGGEINVEMDAAPGVDLSR

SEQ ID NO: 71768 - protein, 19 aa, Homo sapiens
ILTATVDNANILLQIDNAR

SEQ ID NO: 71769 - protein, 13 aa, Homo sapiens
LLEGEDAHLTQYK

SEQ ID NO: 71770 - protein, 20 aa, Homo sapiens
LLEGEDAHLTQYKKEPVTTR

SEQ ID NO: 71771 - protein, 11 aa, Homo sapiens
LSGGLGAGSCR

SEQ ID NO: 71772 - protein, 11 aa, Homo sapiens
LSVEADINGLR

SEQ ID NO: 71773 - protein, 24 aa, Homo sapiens
SFGSGGGYGSSFGGVDGLLAGGEK

SEQ ID NO: 71774 - protein, 28 aa, Homo sapiens
SSCYSFGSGGGYGSSFGGVDGLLAGGEK

SEQ ID NO: 71775 - protein, 36 aa, Homo sapiens
STLGGSSYSSCYSFGSGGGYGSSFGGVDGLLAGGEK

SEQ ID NO: 71776 - protein, 10 aa, Homo sapiens
TKFETEQALR

SEQ ID NO: 71777 - protein, 16 aa, Homo sapiens
TMQALEIELQSQLSMK

SEQ ID NO: 71778 - protein, 23 aa, Homo sapiens
YCVQLSQIQGLIGSVEEQLAQLR

SEQ ID NO: 71779 - protein, 34 aa, Homo sapiens
EEMQVLQCAAGGNVNVEMNAAPGVDLTVLLNNMR

SEQ ID NO: 71780 - protein, 9 aa, Homo sapiens
LASYLENVR

SEQ ID NO: 71781 - protein, 9 aa, Homo sapiens
AAFGGSGGR

SEQ ID NO: 71782 - protein, 17 aa, Homo sapiens
AAFGGSGGRGSSSGGGY

SEQ ID NO: 71783 - protein, 29 aa, Homo sapiens
AAFGGSGGRGSSSGGGYSSGSSSYGSGGR

SEQ ID NO: 71784 - protein, 9 aa, Homo sapiens
DVDNAYMIK

SEQ ID NO: 71785 - protein, 9 aa, Homo sapiens
DYQELMNVK

SEQ ID NO: 71786 - protein, 10 aa, Homo sapiens
EEAEALYHSK

SEQ ID NO: 71787 - protein, 41 aa, Homo sapiens
FGGFGGPGGVGGLGGPGGFGPGGYPGGIHEVSVNQSLLQPL

SEQ ID NO: 71788 - protein, 44 aa, Homo sapiens
FGGFGGPGGVGGLGGPGGFGPGGYPGGIHEVSVNQSLLQPLNVK

SEQ ID NO: 71789 - protein, 14 aa, Homo sapiens
GFSSGSAVVSGGSR

SEQ ID NO: 71790 - protein, 30 aa, Homo sapiens
GGGFGGGSSFGGGSGFSGGGFGGGGFGGGR

SEQ ID NO: 71791 - protein, 22 aa, Homo sapiens
GGGGGGFRGFSSGSAVVSGGSR

SEQ ID NO: 71792 - protein, 20 aa, Homo sapiens
GGGSGFSGGGFGGGGFGGGR

SEQ ID NO: 71793 - protein, 40 aa, Homo sapiens
GGPGGVGGLGGPGGFGPGGYPGGIHEVSVNQSLLQPLNVK

SEQ ID NO: 71794 - protein, 23 aa, Homo sapiens
GGSGGGGSISGGGYGSGGGSGGR

SEQ ID NO: 71795 - protein, 15 aa, Homo sapiens
GGSISGGGYGSGGGK

SEQ ID NO: 71796 - protein, 20 aa, Homo sapiens
GGSSSGGGYGSGGGGSSSVK

SEQ ID NO: 71797 - protein, 25 aa, Homo sapiens
GPGGYPGGIHEVSVNQSLLQPLNVK

SEQ ID NO: 71798 - protein, 16 aa, Homo sapiens
GSSGEAFGSSVTFSFR

SEQ ID NO: 71799 - protein, 19 aa, Homo sapiens
GSSSGGGYGSGGGGSSSVK

SEQ ID NO: 71800 - protein, 20 aa, Homo sapiens
GSSSGGGYSSGSSSYGSGGR

SEQ ID NO: 71801 - protein, 9 aa, Homo sapiens
HGDSLKEIK

SEQ ID NO: 71802 - protein, 16 aa, Homo sapiens
HGGGGGGFGGGGFGSR

SEQ ID NO: 71803 - protein, 28 aa, Homo sapiens
HSSGGGSRGGSSSGGGYGSGGGGSSSVK

SEQ ID NO: 71804 - protein, 19 aa, Homo sapiens
ISVAGGGGGFGAAGGFGGR

SEQ ID NO: 71805 - protein, 10 aa, Homo sapiens
KDVDNAYMIK

SEQ ID NO: 71806 - protein, 12 aa, Homo sapiens
LNDLEEALQQAK

SEQ ID NO: 71807 - protein, 17 aa, Homo sapiens
LNDLEEALQQAKEDLAR

SEQ ID NO: 71808 - protein, 9 aa, Homo sapiens
LQGEIAHVK

SEQ ID NO: 71809 - protein, 25 aa, Homo sapiens
MSGDLSSNVTVSVTSSTISSNVASK

SEQ ID NO: 71810 - protein, 14 aa, Homo sapiens
NKLNDLEEALQQAK

SEQ ID NO: 71811 - protein, 19 aa, Homo sapiens
NKLNDLEEALQQAKEDLAR

SEQ ID NO: 71812 - protein, 12 aa, Homo sapiens
NVQDAIADAEQR

SEQ ID NO: 71813 - protein, 29 aa, Homo sapiens
PGGFGPGGYPGGIHEVSVNQSLLQPLNVK

SEQ ID NO: 71814 - protein, 16 aa, Homo sapiens
PINLEPIFQGYIDSLK

SEQ ID NO: 71815 - protein, 17 aa, Homo sapiens
PINLEPIFQGYIDSLKR

SEQ ID NO: 71816 - protein, 28 aa, Homo sapiens
QSGSRGGSGGGGSISGGGYGSGGGSGGR

SEQ ID NO: 71817 - protein, 46 aa, Homo sapiens
RFGGFGGPGGVGGLGGPGGFGPGGYPGGIHEVSVNQSLLQPLNVKV

SEQ ID NO: 71818 - protein, 27 aa, Homo sapiens
RMSGDLSSNVTVSVTSSTISSNVASKA

SEQ ID NO: 71819 - protein, 11 aa, Homo sapiens
RSTSSFSCLSR

SEQ ID NO: 71820 - protein, 14 aa, Homo sapiens
SGGGFGGGGFGGGR

SEQ ID NO: 71821 - protein, 22 aa, Homo sapiens
SISISVAGGGGGFGAAGGFGGR

SEQ ID NO: 71822 - protein, 10 aa, Homo sapiens
SKEEAEALYH

SEQ ID NO: 71823 - protein, 12 aa, Homo sapiens
SKEEAEALYHSK

SEQ ID NO: 71824 - protein, 9 aa, Homo sapiens
SLVGLGGTK

SEQ ID NO: 71825 - protein, 12 aa, Homo sapiens
SSGSAVVSGGSR

SEQ ID NO: 71826 - protein, 40 aa, Homo sapiens
SSGSSSYGSGGRQSGSRGGSGGGGSISGGGYGSGGGSGGR

SEQ ID NO: 71827 - protein, 48 aa, Homo sapiens
SSGSSSYGSGGRQSGSRGGSGGGGSISGGGYGSGGGSGGRYGSGGGSK

SEQ ID NO: 71828 - protein, 10 aa, Homo sapiens
STSSFSCLSR

SEQ ID NO: 71829 - protein, 18 aa, Homo sapiens
SVAGGGGGFGAAGGFGGR

SEQ ID NO: 71830 - protein, 11 aa, Homo sapiens
TAAENDFVTLK

SEQ ID NO: 71831 - protein, 12 aa, Homo sapiens
TAAENDFVTLKK

SEQ ID NO: 71832 - protein, 18 aa, Homo sapiens
TSQNSELNNMQDLVEDYK

SEQ ID NO: 71833 - protein, 19 aa, Homo sapiens
TSQNSELNNMQDLVEDYKK

SEQ ID NO: 71834 - protein, 17 aa, Homo sapiens
VAGGGGGFGAAGGFGGR

SEQ ID NO: 71835 - protein, 12 aa, Homo sapiens
VDLLNQEIEFLK

SEQ ID NO: 71836 - protein, 9 aa, Homo sapiens
VDPEIQNVK

SEQ ID NO: 71837 - protein, 20 aa, Homo sapiens
VGTRPINLEPIFQGYIDSLK

SEQ ID NO: 71838 - protein, 18 aa, Homo sapiens
VLYDAEISQIHQSVTDTN

SEQ ID NO: 71839 - protein, 27 aa, Homo sapiens
VLYDAEISQIHQSVTDTNVILSMDNSR

SEQ ID NO: 71840 - protein, 10 aa, Homo sapiens
YEELQVTVGR

SEQ ID NO: 71841 - protein, 9 aa, Homo sapiens
YLDGLTAER

SEQ ID NO: 71842 - protein, 9 aa, Homo sapiens
EQIKLLNNK

SEQ ID NO: 71843 - protein, 16 aa, Homo sapiens
FASFIDKVQFLEQQNK

SEQ ID NO: 71844 - protein, 14 aa, Homo sapiens
GAFSSVSMSGGAGR

SEQ ID NO: 71845 - protein, 12 aa, Homo sapiens
LLNNKFASFIDK

SEQ ID NO: 71846 - protein, 12 aa, Homo sapiens
RVELEAALQQAK

SEQ ID NO: 71847 - protein, 11 aa, Homo sapiens
TAAENDFVVLK

SEQ ID NO: 71848 - protein, 12 aa, Homo sapiens
TAAENDFVVLKK

SEQ ID NO: 71849 - protein, 12 aa, Homo sapiens
VDSLNDEINFLK

SEQ ID NO: 71850 - protein, 9 aa, Homo sapiens
VQFLEQQNK

SEQ ID NO: 71851 - protein, 16 aa, Homo sapiens
VQQLQISVDQHGDNLK

SEQ ID NO: 71852 - protein, 14 aa, Homo sapiens
WNLLQQQTTTTSSK

SEQ ID NO: 71853 - protein, 9 aa, Homo sapiens
AQYEEIANR

SEQ ID NO: 71854 - protein, 9 aa, Homo sapiens
EYQELMNTK

SEQ ID NO: 71855 - protein, 17 aa, Homo sapiens
GLGVGFGSGGGSSSSVK

SEQ ID NO: 71856 - protein, 16 aa, Homo sapiens
KQCANLQNAIADAEQR

SEQ ID NO: 71857 - protein, 10 aa, Homo sapiens
LAELEEALQK

SEQ ID NO: 71858 - protein, 27 aa, Homo sapiens
MFFDAELSQMQTHVSDTSVVLSMDNNR

SEQ ID NO: 71859 - protein, 21 aa, Homo sapiens
NLDLDSIIAEVKAQYEEIANR

SEQ ID NO: 71860 - protein, 10 aa, Homo sapiens
NMQDLVEDFK

SEQ ID NO: 71861 - protein, 15 aa, Homo sapiens
QCANLQNAIADAEQR

SEQ ID NO: 71862 - protein, 14 aa, Homo sapiens
SFSTASAITPSVSR

SEQ ID NO: 71863 - protein, 11 aa, Homo sapiens
SGGGGGGGFGR

SEQ ID NO: 71864 - protein, 9 aa, Homo sapiens
SLYNLGGSK

SEQ ID NO: 71865 - protein, 10 aa, Homo sapiens
SLYNLGGSKR

SEQ ID NO: 71866 - protein, 12 aa, Homo sapiens
SRTEAESWYQTK

SEQ ID NO: 71867 - protein, 10 aa, Homo sapiens
TEAESWYQTK

SEQ ID NO: 71868 - protein, 8 aa, Homo sapiens
TSFTSVSR

SEQ ID NO: 71869 - protein, 11 aa, Homo sapiens
TTAENEFVMLK

SEQ ID NO: 71870 - protein, 12 aa, Homo sapiens
VDALMDEINFMK

SEQ ID NO: 71871 - protein, 15 aa, Homo sapiens
VSLAGACGVGGYGSR

SEQ ID NO: 71872 - protein, 10 aa, Homo sapiens
YEELQQTAGR

SEQ ID NO: 71873 - protein, 15 aa, Homo sapiens
QASNLETAIADAEQR

SEQ ID NO: 71874 - protein, 10 aa, Homo sapiens
ALGGFGFGSR

SEQ ID NO: 71875 - protein, 19 aa, Homo sapiens
MSFNCSTRNCSSRPIGGRC

SEQ ID NO: 71876 - protein, 13 aa, Homo sapiens
DSLENTLTESEAR

SEQ ID NO: 71877 - protein, 15 aa, Homo sapiens
EVEQWFTTQTEELNK

SEQ ID NO: 71878 - protein, 9 aa, Homo sapiens
ILDELTLCK

SEQ ID NO: 71879 - protein, 15 aa, Homo sapiens
LNVEVDAAPTVDLNR

SEQ ID NO: 71880 - protein, 11 aa, Homo sapiens
QLVESDINGLR

SEQ ID NO: 71881 - protein, 11 aa, Homo sapiens
SDLEAQVESLK

SEQ ID NO: 71882 - protein, 11 aa, Homo sapiens
SNHEQEVNTLR

SEQ ID NO: 71883 - protein, 11 aa, Homo sapiens
SQYEALVETNR

SEQ ID NO: 71884 - protein, 8 aa, Homo sapiens
YQTELSLR

SEQ ID NO: 71885 - protein, 13 aa, Homo sapiens
DALESTLAETEAR

SEQ ID NO: 71886 - protein, 12 aa, Homo sapiens
AVVGDAQYHHFR

SEQ ID NO: 71887 - protein, 22 aa, Homo sapiens
FHVNLLCGEEQGSDAALHFNPR

SEQ ID NO: 71888 - protein, 16 aa, Homo sapiens
GQPFEVLIIASDDGFK

SEQ ID NO: 71889 - protein, 11 aa, Homo sapiens
LDTSEVVFNSK

SEQ ID NO: 71890 - protein, 14 aa, Homo sapiens
LVEVGGDVQLDSVR

SEQ ID NO: 71891 - protein, 9 aa, Homo sapiens
SEIADLNVR

SEQ ID NO: 71892 - protein, 14 aa, Homo sapiens
TAEEQGELAFQDAK

SEQ ID NO: 71893 - protein, 14 aa, Homo sapiens
EELIADALPVLADR

SEQ ID NO: 71894 - protein, 11 aa, Homo sapiens
LLQSGNSDVVR

SEQ ID NO: 71895 - protein, 24 aa, Homo sapiens
LLTSHTGNTSNSEDILSSACYTVR

SEQ ID NO: 71896 - protein, 26 aa, Homo sapiens
RLLTSHTGNTSNSEDILSSACYTVRN

SEQ ID NO: 71897 - protein, 15 aa, Homo sapiens
SPNQNVQQAAAGALR

SEQ ID NO: 71898 - protein, 12 aa, Homo sapiens
VMGNQVFPEVTR

SEQ ID NO: 71899 - protein, 15 aa, Homo sapiens
VVRSGASLLSNMSRH

SEQ ID NO: 71900 - protein, 34 aa, Homo sapiens
DCAESCTPSYTLQGQVSSGTSSTQCCQEDLCNEK

SEQ ID NO: 71901 - protein, 10 aa, Homo sapiens
HSVVCPASSR

SEQ ID NO: 71902 - protein, 15 aa, Homo sapiens
RKLGLTYNTTCCNKD

SEQ ID NO: 71903 - protein, 16 aa, Homo sapiens
RCNSDLRNKTYFSPRI

SEQ ID NO: 71904 - protein, 24 aa, Homo sapiens
REACQGTSPPVVSCYNASDHVYKG

SEQ ID NO: 71905 - protein, 13 aa, Homo sapiens
TAANVTVSLPVRG

SEQ ID NO: 71906 - protein, 7 aa, Homo sapiens
DGVVLFK

SEQ ID NO: 71907 - protein, 17 aa, Homo sapiens
HNQLPLVIEFTEQTAPK

SEQ ID NO: 71908 - protein, 16 aa, Homo sapiens
IKPHLMSQELPEDWDK

SEQ ID NO: 71909 - protein, 20 aa, Homo sapiens
IKPHLMSQELPEDWDKQPVK

SEQ ID NO: 71910 - protein, 8 aa, Homo sapiens
ILEFFGLK

SEQ ID NO: 71911 - protein, 15 aa, Homo sapiens
ILFIFIDSDHTDNQR

SEQ ID NO: 71912 - protein, 7 aa, Homo sapiens
ITEFCHR

SEQ ID NO: 71913 - protein, 12 aa, Homo sapiens
KSNFAEALAAHK

SEQ ID NO: 71914 - protein, 15 aa, Homo sapiens
LGETYKDHENIVIAK

SEQ ID NO: 71915 - protein, 11 aa, Homo sapiens
SNFAEALAAHK

SEQ ID NO: 71916 - protein, 30 aa, Homo sapiens
TGPAATTLPDGAAAESLVESSEVAVIGFFK

SEQ ID NO: 71917 - protein, 9 aa, Homo sapiens
THILLFLPK

SEQ ID NO: 71918 - protein, 16 aa, Homo sapiens
VDATEESDLAQQYGVR

SEQ ID NO: 71919 - protein, 8 aa, Homo sapiens
VHSFPTLK

SEQ ID NO: 71920 - protein, 12 aa, Homo sapiens
YQLDKDGVVLFK

SEQ ID NO: 71921 - protein, 13 aa, Homo sapiens
AGVVLVTAAGNFR

SEQ ID NO: 71922 - protein, 15 aa, Homo sapiens
AHNAFGGEGVYAIAR

SEQ ID NO: 71923 - protein, 38 aa, Homo sapiens
DDACLYSPASAPEVITVGATNAQDQPVTLGTLGTNFGR

SEQ ID NO: 71924 - protein, 15 aa, Homo sapiens
ILHVFHGLLPGFLVK

SEQ ID NO: 71925 - protein, 10 aa, Homo sapiens
LPGTYVVVLK

SEQ ID NO: 71926 - protein, 20 aa, Homo sapiens
LPGTYVVVLKEETHLSQSER

SEQ ID NO: 71927 - protein, 16 aa, Homo sapiens
LPHVDYIEEDSSVFAQ

SEQ ID NO: 71928 - protein, 11 aa, Homo sapiens
MSGDLLELALK

SEQ ID NO: 71929 - protein, 16 aa, Homo sapiens
VMVTDFENVPEEDGTR

SEQ ID NO: 71930 - protein, 22 aa, Homo sapiens
AQEPVKGPVSTKPGSCPIILIR

SEQ ID NO: 71931 - protein, 12 aa, Homo sapiens
CLKDTDCPGIKK

SEQ ID NO: 71932 - protein, 16 aa, Homo sapiens
GPVSTKPGSCPIILIR

SEQ ID NO: 71933 - protein, 24 aa, Homo sapiens
VKAQEPVKGPVSTKPGSCPIILIR

SEQ ID NO: 71934 - protein, 10 aa, Homo sapiens
VPFNGQDPVK

SEQ ID NO: 71935 - protein, 27 aa, Homo sapiens
KHLFEDSQNKLGAEMVINTSGKYGYKS

SEQ ID NO: 71936 - protein, 11 aa, Homo sapiens
SPPGKPQGPPQ

SEQ ID NO: 71937 - protein, 12 aa, Homo sapiens
SPPGKPQGPPQQ

SEQ ID NO: 71938 - protein, 13 aa, Homo sapiens
SPPGKPQGPPQQE

SEQ ID NO: 71939 - protein, 14 aa, Homo sapiens
SPPGKPQGPPQQEG

SEQ ID NO: 71940 - protein, 18 aa, Homo sapiens
SPPGKPQGPPQQEGNKPQ

SEQ ID NO: 71941 - protein, 27 aa, Homo sapiens
SPPGKPQGPPQQEGNKPQGPPPPGKPQ

SEQ ID NO: 71942 - protein, 19 aa, Homo sapiens
HQEEESETEEDEEDTPGHK

SEQ ID NO: 71943 - protein, 18 aa, Homo sapiens
HSSWSEGEEHGYSSGHSR

SEQ ID NO: 71944 - protein, 11 aa, Homo sapiens
LTMACNKVLSK

SEQ ID NO: 71945 - protein, 11 aa, Homo sapiens
SVVTVIDVFYK

SEQ ID NO: 71946 - protein, 30 aa, Homo sapiens
YGSGSGQSAGFGQHGSGSGQSSGFGQHESR

SEQ ID NO: 71947 - protein, 9 aa, Homo sapiens
DLVTQQLPH

SEQ ID NO: 71948 - protein, 20 aa, Homo sapiens
DLVTQQLPHLMPSNCGLEEK

SEQ ID NO: 71949 - protein, 11 aa, Homo sapiens
IANLGSCNDSK

SEQ ID NO: 71950 - protein, 11 aa, Homo sapiens
NFHQYSVEGGK

SEQ ID NO: 71951 - protein, 11 aa, Homo sapiens
SFWELIGEAAK

SEQ ID NO: 71952 - protein, 12 aa, Homo sapiens
ENFPNFLSACDK

SEQ ID NO: 71953 - protein, 13 aa, Homo sapiens
ENFPNFLSACDKK

SEQ ID NO: 71954 - protein, 11 aa, Homo sapiens
GTNYLADVFEK

SEQ ID NO: 71955 - protein, 12 aa, Homo sapiens
GTNYLADVFEKK

SEQ ID NO: 71956 - protein, 19 aa, Homo sapiens
IDFSEFLSLLGDIATDYHK

SEQ ID NO: 71957 - protein, 12 aa, Homo sapiens
KGTNYLADVFEK

SEQ ID NO: 71958 - protein, 20 aa, Homo sapiens
KIDFSEFLSLLGDIATDYHK

SEQ ID NO: 71959 - protein, 14 aa, Homo sapiens
LGHGVNNAAGQAGK

SEQ ID NO: 71960 - protein, 14 aa, Homo sapiens
LGQGVNHAADQAGK

SEQ ID NO: 71961 - protein, 11 aa, Homo sapiens
FDAPPEAVAAK

SEQ ID NO: 71962 - protein, 9 aa, Homo sapiens
SLIAEVLVK

SEQ ID NO: 71963 - protein, 10 aa, Homo sapiens
AVFLTEALER

SEQ ID NO: 71964 - protein, 11 aa, Homo sapiens
ENDPIEGLDGK

SEQ ID NO: 71965 - protein, 11 aa, Homo sapiens
ENDPIQGPDGK

SEQ ID NO: 71966 - protein, 13 aa, Homo sapiens
FFQSLDGIMFINK

SEQ ID NO: 71967 - protein, 12 aa, Homo sapiens
SSPLYEYIQEQR

SEQ ID NO: 71968 - protein, 10 aa, Homo sapiens
VDFNEFLLFI

SEQ ID NO: 71969 - protein, 23 aa, Homo sapiens
MGQDLMVSVMLINHSSSRRTVKL

SEQ ID NO: 71970 - protein, 27 aa, Homo sapiens
RVISAMVNSLDDNGVLIGNWSGDYSRG

SEQ ID NO: 71971 - protein, 18 aa, Homo sapiens
GADEEPYFGSLSAFVCQH

SEQ ID NO: 71972 - protein, 25 aa, Homo sapiens
SAGCHTLYLSSVSVETLTGALAVQK

SEQ ID NO: 71973 - protein, 23 aa, Homo sapiens
TPGHQNSVQPGAASPSNPCPATR

SEQ ID NO: 71974 - protein, 20 aa, Homo sapiens
CQASFCELHLKPHLEGAAFR

SEQ ID NO: 71975 - protein, 9 aa, Homo sapiens
DHQLLEPIR

SEQ ID NO: 71976 - protein, 14 aa, Homo sapiens
DHQLLEPIRDFEAR

SEQ ID NO: 71977 - protein, 20 aa, Homo sapiens
EQDAVDQVKVIMDALDERAK

SEQ ID NO: 71978 - protein, 9 aa, Homo sapiens
KPPVTFAEK

SEQ ID NO: 71979 - protein, 13 aa, Homo sapiens
RPIIQFVESGDDK

SEQ ID NO: 71980 - protein, 26 aa, Homo sapiens
RPIIQFVESGDDKNSNYFSMDSMEGK

SEQ ID NO: 71981 - protein, 24 aa, Homo sapiens
SCLVCQASFCELHLKPHLEGAAFR

SEQ ID NO: 71982 - protein, 15 aa, Homo sapiens
SGSEEVLCDSCIGNK

SEQ ID NO: 71983 - protein, 12 aa, Homo sapiens
SLGSALKPGEGR

SEQ ID NO: 71984 - protein, 15 aa, Homo sapiens
ADEFLNWHALFESIK

SEQ ID NO: 71985 - protein, 16 aa, Homo sapiens
ADEFLNWHALFESIKR

SEQ ID NO: 71986 - protein, 12 aa, Homo sapiens
KLPFLNWDAFPK

SEQ ID NO: 71987 - protein, 11 aa, Homo sapiens
LPFLNWDAFPK

SEQ ID NO: 71988 - protein, 11 aa, Homo sapiens
DYPNICAGTDR

SEQ ID NO: 71989 - protein, 11 aa, Homo sapiens
HNFPALFGDVK

SEQ ID NO: 71990 - protein, 13 aa, Homo sapiens
AIGKEAGGAAGSK

SEQ ID NO: 71991 - protein, 30 aa, Homo sapiens
LQSGEESTGTNIGEALGHGLGDALSEGVGK

SEQ ID NO: 71992 - protein, 12 aa, Homo sapiens
PGFGAADALGNR

SEQ ID NO: 71993 - protein, 14 aa, Homo sapiens
QVPGFGAADALGNR

SEQ ID NO: 71994 - protein, 17 aa, Homo sapiens
VGEAAHALGNTGHEIGR

SEQ ID NO: 71995 - protein, 10 aa, Homo sapiens
VSEALGQGTR

SEQ ID NO: 71996 - protein, 33 aa, Homo sapiens
GGQGDPAVPTQQPADPSTPEQQNSPSGSEQFVR

SEQ ID NO: 71997 - protein, 16 aa, Homo sapiens
ITLEHLGICCHEYCFK

SEQ ID NO: 71998 - protein, 10 aa, Homo sapiens
ENLQFSAALR

SEQ ID NO: 71999 - protein, 8 aa, Homo sapiens
QDKPLIEK

SEQ ID NO: 72000 - protein, 13 aa, Homo sapiens
AALPAQELEEYNK

SEQ ID NO: 72001 - protein, 8 aa, Homo sapiens
AILQFYPK

SEQ ID NO: 72002 - protein, 7 aa, Homo sapiens
CDIYQSK

SEQ ID NO: 72003 - protein, 7 aa, Homo sapiens
DLPVALR

SEQ ID NO: 72004 - protein, 8 aa, Homo sapiens
DLPVSLRR

SEQ ID NO: 72005 - protein, 15 aa, Homo sapiens
DMVGLDALDAQPLLK

SEQ ID NO: 72006 - protein, 15 aa, Homo sapiens
EAGYEGPLHQCDIYR

SEQ ID NO: 72007 - protein, 23 aa, Homo sapiens
EGANPGFHEAIGDVLALSVSTPK

SEQ ID NO: 72008 - protein, 16 aa, Homo sapiens
ELYEPIWQNFTDPQLR

SEQ ID NO: 72009 - protein, 11 aa, Homo sapiens
ENYNQEWWSLR

SEQ ID NO: 72010 - protein, 15 aa, Homo sapiens
EVVCHASAWDFYNGK

SEQ ID NO: 72011 - protein, 14 aa, Homo sapiens
EVVCHASAWDFYNR

SEQ ID NO: 72012 - protein, 11 aa, Homo sapiens
FHIPSSVPYIR

SEQ ID NO: 72013 - protein, 11 aa, Homo sapiens
FHVPNVTPYIR

SEQ ID NO: 72014 - protein, 7 aa, Homo sapiens
FVEEYDR

SEQ ID NO: 72015 - protein, 24 aa, Homo sapiens
HLHSLNLLSSEGGSDEHDINFLMK

SEQ ID NO: 72016 - protein, 23 aa, Homo sapiens
KEADDFFTSLGLLPVPPEFWNKS

SEQ ID NO: 72017 - protein, 18 aa, Homo sapiens
KELYEPIWQNFTDPQLRR

SEQ ID NO: 72018 - protein, 12 aa, Homo sapiens
KNMQIANHTLKY

SEQ ID NO: 72019 - protein, 16 aa, Homo sapiens
KVLQAGSSRPWQEVLK

SEQ ID NO: 72020 - protein, 7 aa, Homo sapiens
KVQDLER

SEQ ID NO: 72021 - protein, 14 aa, Homo sapiens
LGWPQYNWTPNSAR

SEQ ID NO: 72022 - protein, 12 aa, Homo sapiens
LKYQGLCPPVPR

SEQ ID NO: 72023 - protein, 12 aa, Homo sapiens
LNGYVDAGDSWR

SEQ ID NO: 72024 - protein, 12 aa, Homo sapiens
QDGFTDTGAYWR

SEQ ID NO: 72025 - protein, 7 aa, Homo sapiens
RIIGAVR

SEQ ID NO: 72026 - protein, 15 aa, Homo sapiens
RKFDVNQLQNTTIKR

SEQ ID NO: 72027 - protein, 12 aa, Homo sapiens
RNETHFDAGAKF

SEQ ID NO: 72028 - protein, 19 aa, Homo sapiens
RQEEAALLSQEFAEAWGQK

SEQ ID NO: 72029 - protein, 16 aa, Homo sapiens
RVTNDTESDINYLLKM

SEQ ID NO: 72030 - protein, 10 aa, Homo sapiens
SEGPLPDSGR

SEQ ID NO: 72031 - protein, 10 aa, Homo sapiens
SMLEKPTDGR

SEQ ID NO: 72032 - protein, 14 aa, Homo sapiens
SMYETPSLEQDLER

SEQ ID NO: 72033 - protein, 19 aa, Homo sapiens
TATCWSLDPDLTNILASSR

SEQ ID NO: 72034 - protein, 9 aa, Homo sapiens
TENELHGEK

SEQ ID NO: 72035 - protein, 12 aa, Homo sapiens
TKYQGICPPVTR

SEQ ID NO: 72036 - protein, 11 aa, Homo sapiens
TLGSANLPLAK

SEQ ID NO: 72037 - protein, 10 aa, Homo sapiens
TQGDFDPGAK

SEQ ID NO: 72038 - protein, 8 aa, Homo sapiens
VFDGSITK

SEQ ID NO: 72039 - protein, 15 aa, Homo sapiens
VLQAGSSRPWQEVLK

SEQ ID NO: 72040 - protein, 7 aa, Homo sapiens
WGVFSGR

SEQ ID NO: 72041 - protein, 9 aa, Homo sapiens
YNFDWWYLR

SEQ ID NO: 72042 - protein, 10 aa, Homo sapiens
YQGICPPVTR

SEQ ID NO: 72043 - protein, 10 aa, Homo sapiens
YQGLCPPVPR

SEQ ID NO: 72044 - protein, 10 aa, Homo sapiens
YVELINQAAR

SEQ ID NO: 72045 - protein, 13 aa, Homo sapiens
AYEWNDNEMYLFR

SEQ ID NO: 72046 - protein, 11 aa, Homo sapiens
ISFNFFVTAPK

SEQ ID NO: 72047 - protein, 16 aa, Homo sapiens
LNTILNTMSTIYSTGK

SEQ ID NO: 72048 - protein, 19 aa, Homo sapiens
NSFVGWSTDWSPYADQSIK

SEQ ID NO: 72049 - protein, 16 aa, Homo sapiens
TLYQFQFQEALCQAAK

SEQ ID NO: 72050 - protein, 7 aa, Homo sapiens
VANLKPR

SEQ ID NO: 72051 - protein, 7 aa, Homo sapiens
AALACSK

SEQ ID NO: 72052 - protein, 11 aa, Homo sapiens
AEFNITLIHPK

SEQ ID NO: 72053 - protein, 8 aa, Homo sapiens
AKGFYISK

SEQ ID NO: 72054 - protein, 8 aa, Homo sapiens
ALEQALEK

SEQ ID NO: 72055 - protein, 15 aa, Homo sapiens
AQIINDAFNLASAHK

SEQ ID NO: 72056 - protein, 14 aa, Homo sapiens
DGRQQQDYWLIDVR

SEQ ID NO: 72057 - protein, 10 aa, Homo sapiens
DHSAIPVINR

SEQ ID NO: 72058 - protein, 10 aa, Homo sapiens
DLMVLNDVYR

SEQ ID NO: 72059 - protein, 11 aa, Homo sapiens
DLTALSNMLPK

SEQ ID NO: 72060 - protein, 12 aa, Homo sapiens
DNEETGFGSGTR

SEQ ID NO: 72061 - protein, 23 aa, Homo sapiens
DSQYEMDSEFEGELADDLAGFYR

SEQ ID NO: 72062 - protein, 11 aa, Homo sapiens
EATDVIIIHSK

SEQ ID NO: 72063 - protein, 35 aa, Homo sapiens
EKNKNANSSPVASTTPSASATTNPASATTLDQSKA

SEQ ID NO: 72064 - protein, 7 aa, Homo sapiens
ELWILNR

SEQ ID NO: 72065 - protein, 15 aa, Homo sapiens
ENKEVVLQWFTENSK

SEQ ID NO: 72066 - protein, 16 aa, Homo sapiens
ENSLLFDPLSSSSSNK

SEQ ID NO: 72067 - protein, 18 aa, Homo sapiens
ENSLLFDPLSSSSSNKER

SEQ ID NO: 72068 - protein, 12 aa, Homo sapiens
EVVLQWFTENSK

SEQ ID NO: 72069 - protein, 12 aa, Homo sapiens
FSFSNLIQAVTR

SEQ ID NO: 72070 - protein, 14 aa, Homo sapiens
FSTEYELQQLEQFK

SEQ ID NO: 72071 - protein, 15 aa, Homo sapiens
FSTEYELQQLEQFKK

SEQ ID NO: 72072 - protein, 12 aa, Homo sapiens
GLYVFKGSSTVR

SEQ ID NO: 72073 - protein, 22 aa, Homo sapiens
GPSTPLPEDPNWNVTEFHTTPK

SEQ ID NO: 72074 - protein, 12 aa, Homo sapiens
GVGGSQPPDIDK

SEQ ID NO: 72075 - protein, 27 aa, Homo sapiens
GVGGSQPPDIDKTELVEPTEYLVVHLK

SEQ ID NO: 72076 - protein, 33 aa, Homo sapiens
IAAGHGDYALNVTGPILNFFAGHYDTPYPLPKS

SEQ ID NO: 72077 - protein, 7 aa, Homo sapiens
IQTQLQR

SEQ ID NO: 72078 - protein, 10 aa, Homo sapiens
IVSEFDYVEK

SEQ ID NO: 72079 - protein, 13 aa, Homo sapiens
KAEFNITLIHPKD

SEQ ID NO: 72080 - protein, 13 aa, Homo sapiens
KDNEETGFGSGTR

SEQ ID NO: 72081 - protein, 24 aa, Homo sapiens
KGPSTPLPEDPNWNVTEFHTTPKM

SEQ ID NO: 72082 - protein, 8 aa, Homo sapiens
KIQTQLQR

SEQ ID NO: 72083 - protein, 12 aa, Homo sapiens
KLNYTLSQGHRV

SEQ ID NO: 72084 - protein, 11 aa, Homo sapiens
KQVTPLFIHFR

SEQ ID NO: 72085 - protein, 12 aa, Homo sapiens
KSFPCFDEPAMK

SEQ ID NO: 72086 - protein, 19 aa, Homo sapiens
KVPVTLALNNTLFLIEERQ

SEQ ID NO: 72087 - protein, 14 aa, Homo sapiens
KVVATTQMQAADAR

SEQ ID NO: 72088 - protein, 15 aa, Homo sapiens
KVVATTQMQAADARK

SEQ ID NO: 72089 - protein, 21 aa, Homo sapiens
LFNDYGGGSFSFSNLIQAVTR

SEQ ID NO: 72090 - protein, 13 aa, Homo sapiens
LMFDRSEVYGPMK

SEQ ID NO: 72091 - protein, 10 aa, Homo sapiens
LNYTLSQGHR

SEQ ID NO: 72092 - protein, 12 aa, Homo sapiens
MLSSFLSEDVFK

SEQ ID NO: 72093 - protein, 12 aa, Homo sapiens
NATLVNEADKLR

SEQ ID NO: 72094 - protein, 35 aa, Homo sapiens
PSAIAAGHGDYALNVTGPILNFFAGHYDTPYPLPK

SEQ ID NO: 72095 - protein, 9 aa, Homo sapiens
QASNGVLIR

SEQ ID NO: 72096 - protein, 11 aa, Homo sapiens
QQQDYWLIDVR

SEQ ID NO: 72097 - protein, 10 aa, Homo sapiens
QVTPLFIHFR

SEQ ID NO: 72098 - protein, 16 aa, Homo sapiens
QWMENPNNNPIHPNLR

SEQ ID NO: 72099 - protein, 16 aa, Homo sapiens
QYMPWEAALSSLSYFK

SEQ ID NO: 72100 - protein, 15 aa, Homo sapiens
RFSTEYELQQLEQFK

SEQ ID NO: 72101 - protein, 16 aa, Homo sapiens
RFSTEYELQQLEQFKK

SEQ ID NO: 72102 - protein, 14 aa, Homo sapiens
RNATLVNEADKLRA

SEQ ID NO: 72103 - protein, 23 aa, Homo sapiens
SDQIGLPDFNAGAMENWGLVTYR

SEQ ID NO: 72104 - protein, 8 aa, Homo sapiens
SEVYGPMK

SEQ ID NO: 72105 - protein, 9 aa, Homo sapiens
SEYMEGNVR

SEQ ID NO: 72106 - protein, 10 aa, Homo sapiens
SEYMEGNVRK

SEQ ID NO: 72107 - protein, 11 aa, Homo sapiens
SFPCFDEPAMK

SEQ ID NO: 72108 - protein, 9 aa, Homo sapiens
SIQLPTTVR

SEQ ID NO: 72109 - protein, 15 aa, Homo sapiens
TELVEPTEYLVVHLK

SEQ ID NO: 72110 - protein, 37 aa, Homo sapiens
VMAVDALASSHPLSTPASEINTPAQISELFDAISYSK

SEQ ID NO: 72111 - protein, 9 aa, Homo sapiens
VNYDEENWR

SEQ ID NO: 72112 - protein, 10 aa, Homo sapiens
VNYDEENWRK

SEQ ID NO: 72113 - protein, 17 aa, Homo sapiens
VPVTLALNNTLFLIEER

SEQ ID NO: 72114 - protein, 13 aa, Homo sapiens
VVATTQMQAADAR

SEQ ID NO: 72115 - protein, 14 aa, Homo sapiens
VVATTQMQAADARK

SEQ ID NO: 72116 - protein, 12 aa, Homo sapiens
YLSYTLNPDLIR

SEQ ID NO: 72117 - protein, 13 aa, Homo sapiens
YLSYTLNPDLIRK

SEQ ID NO: 72118 - protein, 15 aa, Homo sapiens
AELGGHLDQQVEEFR

SEQ ID NO: 72119 - protein, 16 aa, Homo sapiens
AELGGHLDQQVEEFRR

SEQ ID NO: 72120 - protein, 24 aa, Homo sapiens
AEVSADQVATVMWDYFSQLSNNAK

SEQ ID NO: 72121 - protein, 13 aa, Homo sapiens
AGDVEGHLSFLEK

SEQ ID NO: 72122 - protein, 11 aa, Homo sapiens
AKIDQNVEELK

SEQ ID NO: 72123 - protein, 13 aa, Homo sapiens
AKIDQNVEELKGR

SEQ ID NO: 72124 - protein, 10 aa, Homo sapiens
ALVQQMEQLR

SEQ ID NO: 72125 - protein, 12 aa, Homo sapiens
ALVQQMEQLRQK

SEQ ID NO: 72126 - protein, 10 aa, Homo sapiens
APYAQDTQEK

SEQ ID NO: 72127 - protein, 23 aa, Homo sapiens
APYAQDTQEKLNHQLEGLTFQMK

SEQ ID NO: 72128 - protein, 13 aa, Homo sapiens
ARLLPHANEVSQK

SEQ ID NO: 72129 - protein, 7 aa, Homo sapiens
ATELHER

SEQ ID NO: 72130 - protein, 11 aa, Homo sapiens
DKVNSFFSTFK

SEQ ID NO: 72131 - protein, 12 aa, Homo sapiens
DKVNSFFSTFKE

SEQ ID NO: 72132 - protein, 13 aa, Homo sapiens
DKVNSFFSTFKEK

SEQ ID NO: 72133 - protein, 14 aa, Homo sapiens
DLRDKVNSFFSTFK

SEQ ID NO: 72134 - protein, 16 aa, Homo sapiens
DLRDKVNSFFSTFKEK

SEQ ID NO: 72135 - protein, 17 aa, Homo sapiens
DSEKLKEEIGKELEELR

SEQ ID NO: 72136 - protein, 11 aa, Homo sapiens
DVEGHLSFLEK

SEQ ID NO: 72137 - protein, 8 aa, Homo sapiens
EAVEHLQK

SEQ ID NO: 72138 - protein, 22 aa, Homo sapiens
EAVEHLQKSELTQQLNALFQDK

SEQ ID NO: 72139 - protein, 35 aa, Homo sapiens
EAVEHLQKSELTQQLNALFQDKLGEVNTYAGDLQK

SEQ ID NO: 72140 - protein, 11 aa, Homo sapiens
EEIGKELEELR

SEQ ID NO: 72141 - protein, 14 aa, Homo sapiens
ELQQRLEPYADQLR

SEQ ID NO: 72142 - protein, 11 aa, Homo sapiens
ENADSLQASLR

SEQ ID NO: 72143 - protein, 13 aa, Homo sapiens
ENADSLQASLRPH

SEQ ID NO: 72144 - protein, 14 aa, Homo sapiens
ENADSLQASLRPHA

SEQ ID NO: 72145 - protein, 15 aa, Homo sapiens
ENADSLQASLRPHAD

SEQ ID NO: 72146 - protein, 18 aa, Homo sapiens
ENADSLQASLRPHADELK

SEQ ID NO: 72147 - protein, 20 aa, Homo sapiens
ENADSLQASLRPHADELKAK

SEQ ID NO: 72148 - protein, 23 aa, Homo sapiens
EVSADQVATVMWDYFSQLSNNAK

SEQ ID NO: 72149 - protein, 12 aa, Homo sapiens
GDVEGHLSFLEK

SEQ ID NO: 72150 - protein, 12 aa, Homo sapiens
GEVNTYAGDLQK

SEQ ID NO: 72151 - protein, 12 aa, Homo sapiens
GGHLDQQVEEFR

SEQ ID NO: 72152 - protein, 11 aa, Homo sapiens
GHLDQQVEEFR

SEQ ID NO: 72153 - protein, 8 aa, Homo sapiens
GHLSFLEK

SEQ ID NO: 72154 - protein, 12 aa, Homo sapiens
GNLRGNTEGLQK

SEQ ID NO: 72155 - protein, 16 aa, Homo sapiens
GPHAGDVEGHLSFLEK

SEQ ID NO: 72156 - protein, 11 aa, Homo sapiens
GRLTPYADEFK

SEQ ID NO: 72157 - protein, 14 aa, Homo sapiens
HAGDVEGHLSFLEK

SEQ ID NO: 72158 - protein, 8 aa, Homo sapiens
HANEVSQK

SEQ ID NO: 72159 - protein, 10 aa, Homo sapiens
HLDQQVEEFR

SEQ ID NO: 72160 - protein, 9 aa, Homo sapiens
IDQNVEELK

SEQ ID NO: 72161 - protein, 11 aa, Homo sapiens
IDQNVEELKGR

SEQ ID NO: 72162 - protein, 9 aa, Homo sapiens
IDQTVEELR

SEQ ID NO: 72163 - protein, 10 aa, Homo sapiens
IDQTVEELRR

SEQ ID NO: 72164 - protein, 9 aa, Homo sapiens
ISASAEELR

SEQ ID NO: 72165 - protein, 10 aa, Homo sapiens
ISASAEELRQ

SEQ ID NO: 72166 - protein, 12 aa, Homo sapiens
KLVPFATELHER

SEQ ID NO: 72167 - protein, 9 aa, Homo sapiens
KNAEELKAR

SEQ ID NO: 72168 - protein, 16 aa, Homo sapiens
LAELGGHLDQQVEEFR

SEQ ID NO: 72169 - protein, 19 aa, Homo sapiens
LAKDSEKLKEEIGKELEEL

SEQ ID NO: 72170 - protein, 20 aa, Homo sapiens
LAKDSEKLKEEIGKELEELR

SEQ ID NO: 72171 - protein, 22 aa, Homo sapiens
LAKDSEKLKEEIGKELEELRAR

SEQ ID NO: 72172 - protein, 9 aa, Homo sapiens
LAPLAEDVR

SEQ ID NO: 72173 - protein, 9 aa, Homo sapiens
LEPYADQLR

SEQ ID NO: 72174 - protein, 20 aa, Homo sapiens
LEPYADQLRTQVSTQAEQLR

SEQ ID NO: 72175 - protein, 13 aa, Homo sapiens
LGEVNTYAGDLQK

SEQ ID NO: 72176 - protein, 14 aa, Homo sapiens
LGEVNTYAGDLQKK

SEQ ID NO: 72177 - protein, 13 aa, Homo sapiens
LGGHLDQQVEEFR

SEQ ID NO: 72178 - protein, 11 aa, Homo sapiens
LGPHAGDVEGH

SEQ ID NO: 72179 - protein, 12 aa, Homo sapiens
LGPHAGDVEGHL

SEQ ID NO: 72180 - protein, 14 aa, Homo sapiens
LGPHAGDVEGHLSF

SEQ ID NO: 72181 - protein, 17 aa, Homo sapiens
LGPHAGDVEGHLSFLEK

SEQ ID NO: 72182 - protein, 20 aa, Homo sapiens
LGPHAGDVEGHLSFLEKDLR

SEQ ID NO: 72183 - protein, 7 aa, Homo sapiens
LKEEIGK

SEQ ID NO: 72184 - protein, 13 aa, Homo sapiens
LKEEIGKELEELR

SEQ ID NO: 72185 - protein, 15 aa, Homo sapiens
LKEEIGKELEELRAR

SEQ ID NO: 72186 - protein, 11 aa, Homo sapiens
LLPHANEVSQK

SEQ ID NO: 72187 - protein, 17 aa, Homo sapiens
LLPHANEVSQKIGDNLR

SEQ ID NO: 72188 - protein, 10 aa, Homo sapiens
LNHQLEGLTF

SEQ ID NO: 72189 - protein, 11 aa, Homo sapiens
LNHQLEGLTFQ

SEQ ID NO: 72190 - protein, 13 aa, Homo sapiens
LNHQLEGLTFQMK

SEQ ID NO: 72191 - protein, 10 aa, Homo sapiens
LPHANEVSQK

SEQ ID NO: 72192 - protein, 13 aa, Homo sapiens
LQASLRPHADELK

SEQ ID NO: 72193 - protein, 9 aa, Homo sapiens
LTPYADEFK

SEQ ID NO: 72194 - protein, 20 aa, Homo sapiens
LTPYADEFKVKIDQTVEELR

SEQ ID NO: 72195 - protein, 21 aa, Homo sapiens
LTPYADEFKVKIDQTVEELRR

SEQ ID NO: 72196 - protein, 12 aa, Homo sapiens
LTQQLNALFQDK

SEQ ID NO: 72197 - protein, 11 aa, Homo sapiens
LVPFATELHER

SEQ ID NO: 72198 - protein, 6 aa, Homo sapiens
MERVLR

SEQ ID NO: 72199 - protein, 9 aa, Homo sapiens
PFATELHER

SEQ ID NO: 72200 - protein, 7 aa, Homo sapiens
PHADELK

SEQ ID NO: 72201 - protein, 9 aa, Homo sapiens
PHANEVSQK

SEQ ID NO: 72202 - protein, 19 aa, Homo sapiens
PLAEDVRGNLRGNTEGLQK

SEQ ID NO: 72203 - protein, 7 aa, Homo sapiens
PYADEFK

SEQ ID NO: 72204 - protein, 9 aa, Homo sapiens
PYADEFKVK

SEQ ID NO: 72205 - protein, 19 aa, Homo sapiens
PYADEFKVKIDQTVEELRR

SEQ ID NO: 72206 - protein, 9 aa, Homo sapiens
PYAQDTQEK

SEQ ID NO: 72207 - protein, 22 aa, Homo sapiens
PYAQDTQEKLNHQLEGLTFQMK

SEQ ID NO: 72208 - protein, 23 aa, Homo sapiens
PYAQDTQEKLNHQLEGLTFQMKK

SEQ ID NO: 72209 - protein, 19 aa, Homo sapiens
QKLGPHAGDVEGHLSFLEK

SEQ ID NO: 72210 - protein, 8 aa, Homo sapiens
QLTPYAQR

SEQ ID NO: 72211 - protein, 25 aa, Homo sapiens
RAEVSADQVATVMWDYFSQLSNNAK

SEQ ID NO: 72212 - protein, 9 aa, Homo sapiens
RQLTPYAQR

SEQ ID NO: 72213 - protein, 12 aa, Homo sapiens
RQLTPYAQRMER

SEQ ID NO: 72214 - protein, 12 aa, Homo sapiens
RRVEPYGENFNK

SEQ ID NO: 72215 - protein, 11 aa, Homo sapiens
RVEPYGENFNK

SEQ ID NO: 72216 - protein, 21 aa, Homo sapiens
RVEPYGENFNKALVQQMEQLR

SEQ ID NO: 72217 - protein, 23 aa, Homo sapiens
RVEPYGENFNKALVQQMEQLRQK

SEQ ID NO: 72218 - protein, 8 aa, Homo sapiens
SELTQQLN

SEQ ID NO: 72219 - protein, 14 aa, Homo sapiens
SELTQQLNALFQDK

SEQ ID NO: 72220 - protein, 27 aa, Homo sapiens
SELTQQLNALFQDKLGEVNTYAGDLQK

SEQ ID NO: 72221 - protein, 10 aa, Homo sapiens
SLAELGGHLD

SEQ ID NO: 72222 - protein, 16 aa, Homo sapiens
SLAELGGHLDQQVEEF

SEQ ID NO: 72223 - protein, 17 aa, Homo sapiens
SLAELGGHLDQQVEEFR

SEQ ID NO: 72224 - protein, 18 aa, Homo sapiens
SLAELGGHLDQQVEEFRR

SEQ ID NO: 72225 - protein, 19 aa, Homo sapiens
SLAELGGHLDQQVEEFRRR

SEQ ID NO: 72226 - protein, 12 aa, Homo sapiens
SLAPYAQDTQEK

SEQ ID NO: 72227 - protein, 25 aa, Homo sapiens
SLAPYAQDTQEKLNHQLEGLTFQMK

SEQ ID NO: 72228 - protein, 26 aa, Homo sapiens
SLAPYAQDTQEKLNHQLEGLTFQMKK

SEQ ID NO: 72229 - protein, 34 aa, Homo sapiens
SLAPYAQDTQEKLNHQLEGLTFQMKKNAEELKAR

SEQ ID NO: 72230 - protein, 23 aa, Homo sapiens
TLSLPELEQQQEQQQEQQQEQVQ

SEQ ID NO: 72231 - protein, 30 aa, Homo sapiens
TLSLPELEQQQEQQQEQQQEQVQMLAPLES

SEQ ID NO: 72232 - protein, 8 aa, Homo sapiens
TPYADEFK

SEQ ID NO: 72233 - protein, 24 aa, Homo sapiens
TQQLNALFQDKLGEVNTYAGDLQK

SEQ ID NO: 72234 - protein, 11 aa, Homo sapiens
TQVSTQAEQLR

SEQ ID NO: 72235 - protein, 10 aa, Homo sapiens
VEPYGENFNK

SEQ ID NO: 72236 - protein, 20 aa, Homo sapiens
VEPYGENFNKALVQQMEQLR

SEQ ID NO: 72237 - protein, 11 aa, Homo sapiens
VKIDQTVEELR

SEQ ID NO: 72238 - protein, 12 aa, Homo sapiens
VKIDQTVEELRR

SEQ ID NO: 72239 - protein, 20 aa, Homo sapiens
VLRENADSLQASLRPHADEL

SEQ ID NO: 72240 - protein, 21 aa, Homo sapiens
VLRENADSLQASLRPHADELK

SEQ ID NO: 72241 - protein, 23 aa, Homo sapiens
VLRENADSLQASLRPHADELKAK

SEQ ID NO: 72242 - protein, 34 aa, Homo sapiens
VLRENADSLQASLRPHADELKAKIDQNVEELKGR

SEQ ID NO: 72243 - protein, 9 aa, Homo sapiens
VNSFFSTFK

SEQ ID NO: 72244 - protein, 11 aa, Homo sapiens
VNSFFSTFKEK

SEQ ID NO: 72245 - protein, 12 aa, Homo sapiens
WDYFSQLSNNAK

SEQ ID NO: 72246 - protein, 9 aa, Homo sapiens
EACLLYEIK

SEQ ID NO: 72247 - protein, 11 aa, Homo sapiens
GPSTGDPTLRR

SEQ ID NO: 72248 - protein, 32 aa, Homo sapiens
LFWHMDQQNRQGLRDLVNSGVTIQIMRASEYY

SEQ ID NO: 72249 - protein, 16 aa, Homo sapiens
APVYFYEFQHQPSWLK

SEQ ID NO: 72250 - protein, 31 aa, Homo sapiens
HPQELLASADFQPVPSIVGVNNNEFGWLIPK

SEQ ID NO: 72251 - protein, 13 aa, Homo sapiens
SKEEILAINKPFK

SEQ ID NO: 72252 - protein, 15 aa, Homo sapiens
TTHTGQVLGSLVHVK

SEQ ID NO: 72253 - protein, 13 aa, Homo sapiens
SSNHPEMIQVGQK

SEQ ID NO: 72254 - protein, 16 aa, Homo sapiens
VGSSADILYASSGSSR

SEQ ID NO: 72255 - protein, 7 aa, Homo sapiens
EQAGEPK

SEQ ID NO: 72256 - protein, 19 aa, Homo sapiens
KDFVEIWDNHTSGNILGRY

SEQ ID NO: 72257 - protein, 14 aa, Homo sapiens
KLCSSVNVSNEIKS

SEQ ID NO: 72258 - protein, 34 aa, Homo sapiens
RFQFCGRNASAVPVFYSSMSTAMVIFKSGVVNRN

SEQ ID NO: 72259 - protein, 20 aa, Homo sapiens
YCGNTIPDSIDTSSNTAVVR

SEQ ID NO: 72260 - protein, 9 aa, Homo sapiens
DSHLTAVGK

SEQ ID NO: 72261 - protein, 13 aa, Homo sapiens
IAAFNIQTFGETK

SEQ ID NO: 72262 - protein, 23 aa, Homo sapiens
LLDNLNQDAPDTYHYVVSEPLGR

SEQ ID NO: 72263 - protein, 10 aa, Homo sapiens
YDIALVQEVR

SEQ ID NO: 72264 - protein, 9 aa, Homo sapiens
AGAVNPTVK

SEQ ID NO: 72265 - protein, 10 aa, Homo sapiens
CGIAVAPVSR

SEQ ID NO: 72266 - protein, 10 aa, Homo sapiens
CQYYSVSFSK

SEQ ID NO: 72267 - protein, 18 aa, Homo sapiens
CSGPGLPLYTLHSSVNDK

SEQ ID NO: 72268 - protein, 7 aa, Homo sapiens
DCTFITK

SEQ ID NO: 72269 - protein, 17 aa, Homo sapiens
FRPSEPHFTLDGNSFYK

SEQ ID NO: 72270 - protein, 15 aa, Homo sapiens
GSGYQGDKIMHAINR

SEQ ID NO: 72271 - protein, 9 aa, Homo sapiens
HICYFQIDK

SEQ ID NO: 72272 - protein, 10 aa, Homo sapiens
HICYFQIDKK

SEQ ID NO: 72273 - protein, 14 aa, Homo sapiens
HSYTASYDIYDLNK

SEQ ID NO: 72274 - protein, 15 aa, Homo sapiens
HSYTASYDIYDLNKR

SEQ ID NO: 72275 - protein, 9 aa, Homo sapiens
IEPNLPSYR

SEQ ID NO: 72276 - protein, 9 aa, Homo sapiens
IISNEEGYR

SEQ ID NO: 72277 - protein, 7 aa, Homo sapiens
IMHAINR

SEQ ID NO: 72278 - protein, 8 aa, Homo sapiens
IQLSDYTK

SEQ ID NO: 72279 - protein, 7 aa, Homo sapiens
ISLQWLR

SEQ ID NO: 72280 - protein, 13 aa, Homo sapiens
KKLDFIILNETKF

SEQ ID NO: 72281 - protein, 11 aa, Homo sapiens
KLDFIILNETK

SEQ ID NO: 72282 - protein, 10 aa, Homo sapiens
KTYTLTDYLK

SEQ ID NO: 72283 - protein, 16 aa, Homo sapiens
KYPLLLDVYAGPCSQK

SEQ ID NO: 72284 - protein, 15 aa, Homo sapiens
LASTENIIVASFDGR

SEQ ID NO: 72285 - protein, 12 aa, Homo sapiens
LAYVWNNDIYVK

SEQ ID NO: 72286 - protein, 14 aa, Homo sapiens
LGTFEVEDQIEAAR

SEQ ID NO: 72287 - protein, 7 aa, Homo sapiens
LKLYSLR

SEQ ID NO: 72288 - protein, 8 aa, Homo sapiens
MGFVDNKR

SEQ ID NO: 72289 - protein, 10 aa, Homo sapiens
MLQNVQMPSK

SEQ ID NO: 72290 - protein, 11 aa, Homo sapiens
MLQNVQMPSKK

SEQ ID NO: 72291 - protein, 13 aa, Homo sapiens
QHIEMSTTGWVGR

SEQ ID NO: 72292 - protein, 7 aa, Homo sapiens
QLITEER

SEQ ID NO: 72293 - protein, 25 aa, Homo sapiens
QVEYLLIHGTADDNVHFQQSAQISK

SEQ ID NO: 72294 - protein, 18 aa, Homo sapiens
RIPNNTQWVTWSPVGHKL

SEQ ID NO: 72295 - protein, 20 aa, Homo sapiens
RIQNYSVMDICDYDESSGRW

SEQ ID NO: 72296 - protein, 15 aa, Homo sapiens
RLGTFEVEDQIEAAR

SEQ ID NO: 72297 - protein, 24 aa, Homo sapiens
RYMGLPTPEDNLDHYRNSTVMSRA

SEQ ID NO: 72298 - protein, 9 aa, Homo sapiens
TYTLTDYLK

SEQ ID NO: 72299 - protein, 10 aa, Homo sapiens
VLEDNSALDK

SEQ ID NO: 72300 - protein, 12 aa, Homo sapiens
VTCLSCELNPER

SEQ ID NO: 72301 - protein, 24 aa, Homo sapiens
VWNNDIYVKIEPNLPSYRITWTGK

SEQ ID NO: 72302 - protein, 11 aa, Homo sapiens
WEYYDSVYTER

SEQ ID NO: 72303 - protein, 10 aa, Homo sapiens
WISDHEYLYK

SEQ ID NO: 72304 - protein, 15 aa, Homo sapiens
YMGLPTPEDNLDHYR

SEQ ID NO: 72305 - protein, 15 aa, Homo sapiens
YPLLLDVYAGPCSQK

SEQ ID NO: 72306 - protein, 19 aa, Homo sapiens
KEGITLNSSNPSGNAFLKI

SEQ ID NO: 72307 - protein, 8 aa, Homo sapiens
DYYNLTKF

SEQ ID NO: 72308 - protein, 21 aa, Homo sapiens
IAEDLVTLQNLGVSHYRFSIS

SEQ ID NO: 72309 - protein, 17 aa, Homo sapiens
KFGLYHVDFNNTNRPRT

SEQ ID NO: 72310 - protein, 22 aa, Homo sapiens
QDTVDFLSLDLSYECQNEASLR

SEQ ID NO: 72311 - protein, 18 aa, Homo sapiens
AIRMTQSPFSLSASVGDR

SEQ ID NO: 72312 - protein, 9 aa, Homo sapiens
FSGSILGNK

SEQ ID NO: 72313 - protein, 13 aa, Homo sapiens
PSWYQQTPGQAPR

SEQ ID NO: 72314 - protein, 16 aa, Homo sapiens
SSGVPDRFSGSILGNK

SEQ ID NO: 72315 - protein, 11 aa, Homo sapiens
WYQQTPGQAPR

SEQ ID NO: 72316 - protein, 11 aa, Homo sapiens
KSLWEQKGGSK

SEQ ID NO: 72317 - protein, 13 aa, Homo sapiens
YKFVATGHGKYEK

SEQ ID NO: 72318 - protein, 18 aa, Homo sapiens
KLNQLYNCSSSLSFMDSC

SEQ ID NO: 72319 - protein, 22 aa, Homo sapiens
RGNVNGTFIIHPDSGNLTVARS

SEQ ID NO: 72320 - protein, 19 aa, Homo sapiens
RIQGNQLFLNVTPDYEEKS

SEQ ID NO: 72321 - protein, 26 aa, Homo sapiens
KNPELSGSLMTLSNVSCLSNTPARKI

SEQ ID NO: 72322 - protein, 19 aa, Homo sapiens
RHLQVWSPEAQRNISLQDI

SEQ ID NO: 72323 - protein, 16 aa, Homo sapiens
AFYNNVLGEYEEYITK

SEQ ID NO: 72324 - protein, 33 aa, Homo sapiens
ALQDPNVAAFMVEPIQGEAGVVVPDPGYLMGVR

SEQ ID NO: 72325 - protein, 16 aa, Homo sapiens
HQVLFIADEIQTGLAR

SEQ ID NO: 72326 - protein, 20 aa, Homo sapiens
KYFDFLSSYSAVNQGHCHPK

SEQ ID NO: 72327 - protein, 16 aa, Homo sapiens
PGEHGSTYGGNPLGCR

SEQ ID NO: 72328 - protein, 20 aa, Homo sapiens
VAIAALEVLEEENLAENADK

SEQ ID NO: 72329 - protein, 18 aa, Homo sapiens
WLAVDYENVRPDIVLLGK

SEQ ID NO: 72330 - protein, 19 aa, Homo sapiens
YFDFLSSYSAVNQGHCHPK

SEQ ID NO: 72331 - protein, 15 aa, Homo sapiens
YGAHNYHPLPVALER

SEQ ID NO: 72332 - protein, 23 aa, Homo sapiens
YGAHNYHPLPVALERGKGIYLWD

SEQ ID NO: 72333 - protein, 14 aa, Homo sapiens
RKYADKIYNISMKH

SEQ ID NO: 72334 - protein, 29 aa, Homo sapiens
RNLDPENGSGMALQPLQAAPEPGAQGQRE

SEQ ID NO: 72335 - protein, 21 aa, Homo sapiens
RYRQAIPNVTVPNTTCHLPRP

SEQ ID NO: 72336 - protein, 28 aa, Homo sapiens
TRGRSISFPALLPIPGSNRSSVIMTAKP

SEQ ID NO: 72337 - protein, 32 aa, Homo sapiens
MSEEVTGQFSVHPETPKPSISSNNSNPVEDKD

SEQ ID NO: 72338 - protein, 15 aa, Homo sapiens
GPEDQDISISFAWDK

SEQ ID NO: 72339 - protein, 11 aa, Homo sapiens
SSALQVSGSTR

SEQ ID NO: 72340 - protein, 19 aa, Homo sapiens
RRQAVELNVVAIVNDTVGT

SEQ ID NO: 72341 - protein, 23 aa, Homo sapiens
RRQGAYNIDVVAVVNDTVGTMMG

SEQ ID NO: 72342 - protein, 13 aa, Homo sapiens
IFNETKNPTLTRR

SEQ ID NO: 72343 - protein, 18 aa, Homo sapiens
SFSWSGGAFLYPPNMSPT

SEQ ID NO: 72344 - protein, 18 aa, Homo sapiens
ASQGISSALAWYQQKPGK

SEQ ID NO: 72345 - protein, 11 aa, Homo sapiens
ASSLESGVPSR

SEQ ID NO: 72346 - protein, 33 aa, Homo sapiens
REDLVRDTPPGGPSSLGNQSTCLLEVSLVTPRK

SEQ ID NO: 72347 - protein, 18 aa, Homo sapiens
KNLNYSVPEEQGAGTVIG

SEQ ID NO: 72348 - protein, 15 aa, Homo sapiens
RETQDEYNVTIVARD

SEQ ID NO: 72349 - protein, 18 aa, Homo sapiens
NLEAVETLGSTSVICSDK

SEQ ID NO: 72350 - protein, 12 aa, Homo sapiens
VLGFCQLYLNEK

SEQ ID NO: 72351 - protein, 37 aa, Homo sapiens
AQPIEPITAAPSGSGNGSGSSSSGGSSGGSGFCAVRA

SEQ ID NO: 72352 - protein, 24 aa, Homo sapiens
ALAGWLRPEDGGQAEGAEDELEVR

SEQ ID NO: 72353 - protein, 10 aa, Homo sapiens
FNAPFDVGIK

SEQ ID NO: 72354 - protein, 15 aa, Homo sapiens
LSGVQYQQHSQALGK

SEQ ID NO: 72355 - protein, 13 aa, Homo sapiens
TPVAHTTSASSSR

SEQ ID NO: 72356 - protein, 11 aa, Homo sapiens
AQCPCILEGYK

SEQ ID NO: 72357 - protein, 18 aa, Homo sapiens
ASQDPLCGLCGNFNGNMK

SEQ ID NO: 72358 - protein, 24 aa, Homo sapiens
ASQDPLCGLCGNFNGNMKDDFETR

SEQ ID NO: 72359 - protein, 25 aa, Homo sapiens
ATECHHSAVPVDGCNCPDGTYLNQK

SEQ ID NO: 72360 - protein, 15 aa, Homo sapiens
CSVINSQTFATCHSK

SEQ ID NO: 72361 - protein, 24 aa, Homo sapiens
DIGVISLPYTSNGLQITPFGQSVR

SEQ ID NO: 72362 - protein, 9 aa, Homo sapiens
DSPQTAPDK

SEQ ID NO: 72363 - protein, 21 aa, Homo sapiens
ESPLCGDVSFVTDPCSLNAFR

SEQ ID NO: 72364 - protein, 12 aa, Homo sapiens
ETDPCSMSQLNK

SEQ ID NO: 72365 - protein, 22 aa, Homo sapiens
FGAACAPTCQMLATGVACVPTK

SEQ ID NO: 72366 - protein, 21 aa, Homo sapiens
FILAEQSTVINGITCHCINGR

SEQ ID NO: 72367 - protein, 8 aa, Homo sapiens
GPDGSISR

SEQ ID NO: 72368 - protein, 8 aa, Homo sapiens
GVLLWGWR

SEQ ID NO: 72369 - protein, 7 aa, Homo sapiens
HMTILIR

SEQ ID NO: 72370 - protein, 17 aa, Homo sapiens
ILTENVICGNSGVTCSR

SEQ ID NO: 72371 - protein, 16 aa, Homo sapiens
IVISQDEVVTNNGEAK

SEQ ID NO: 72372 - protein, 12 aa, Homo sapiens
KAQCPCILEGYK

SEQ ID NO: 72373 - protein, 16 aa, Homo sapiens
KCSVINSQTFATCHSK

SEQ ID NO: 72374 - protein, 16 aa, Homo sapiens
KYMGQMCGLCGNFDGK

SEQ ID NO: 72375 - protein, 19 aa, Homo sapiens
LDDPGEICTFQDIPSTHVR

SEQ ID NO: 72376 - protein, 11 aa, Homo sapiens
LKDSPQTAPDK

SEQ ID NO: 72377 - protein, 19 aa, Homo sapiens
QDKIVISQDEVVTNNGEAK

SEQ ID NO: 72378 - protein, 9 aa, Homo sapiens
RGPDGSISR

SEQ ID NO: 72379 - protein, 18 aa, Homo sapiens
SGVSHSETSLVAVVYLSR

SEQ ID NO: 72380 - protein, 25 aa, Homo sapiens
SPGLCSVGQCPANQVYQECGSACVK

SEQ ID NO: 72381 - protein, 8 aa, Homo sapiens
TCLSLSDR

SEQ ID NO: 72382 - protein, 7 aa, Homo sapiens
TGTVFER

SEQ ID NO: 72383 - protein, 12 aa, Homo sapiens
VCAETHCSMLLR

SEQ ID NO: 72384 - protein, 11 aa, Homo sapiens
VTNEFVSEEGK

SEQ ID NO: 72385 - protein, 17 aa, Homo sapiens
VTNEFVSEEGKFLEPHK

SEQ ID NO: 72386 - protein, 12 aa, Homo sapiens
VYHLPYYEACVR

SEQ ID NO: 72387 - protein, 15 aa, Homo sapiens
YMGQMCGLCGNFDGK

SEQ ID NO: 72388 - protein, 14 aa, Homo sapiens
YVASSELELVNSWK

SEQ ID NO: 72389 - protein, 25 aa, Homo sapiens
RRQISQKAFLFNSSEQVAEFVISRP

SEQ ID NO: 72390 - protein, 26 aa, Homo sapiens
KFSIAILPFSIKAMAEANVSLRRMKK

SEQ ID NO: 72391 - protein, 10 aa, Homo sapiens
FFALLTPTWK

SEQ ID NO: 72392 - protein, 14 aa, Homo sapiens
HMSTCALCDFCSLK

SEQ ID NO: 72393 - protein, 12 aa, Homo sapiens
LEQCHSEASLQR

SEQ ID NO: 72394 - protein, 26 aa, Homo sapiens
TPFVSPLLASQSLSIGNQVGSPESGR

SEQ ID NO: 72395 - protein, 11 aa, Homo sapiens
YMEEEILGFGK

SEQ ID NO: 72396 - protein, 16 aa, Homo sapiens
RKVHLMGYNCNATTKC

SEQ ID NO: 72397 - protein, 11 aa, Homo sapiens
FIESAHTELAK

SEQ ID NO: 72398 - protein, 16 aa, Homo sapiens
LPAEPPALLQTHPPCR

SEQ ID NO: 72399 - protein, 27 aa, Homo sapiens
SDFVTLPFQGAEVLLDSVMPLSDDDQF

SEQ ID NO: 72400 - protein, 11 aa, Homo sapiens
VCQASQLQGQK

SEQ ID NO: 72401 - protein, 22 aa, Homo sapiens
KISLKIQNCRNVTSLPCLSLRK

SEQ ID NO: 72402 - protein, 23 aa, Homo sapiens
KEPVGCVNNISFLASLAGSTSRN

SEQ ID NO: 72403 - protein, 14 aa, Homo sapiens
ASSALVVCGGQGHR

SEQ ID NO: 72404 - protein, 10 aa, Homo sapiens
FILLLQDMLK

SEQ ID NO: 72405 - protein, 20 aa, Homo sapiens
GNYQNLNQSVAHDWTSGLQR

SEQ ID NO: 72406 - protein, 16 aa, Homo sapiens
LPLQMALTELETLAEK

SEQ ID NO: 72407 - protein, 26 aa, Homo sapiens
MGQIAIVSFQNSTPKVIECFNVESRI

SEQ ID NO: 72408 - protein, 12 aa, Homo sapiens
KNLSDVNILHRL

SEQ ID NO: 72409 - protein, 17 aa, Homo sapiens
KLINYNNSITNSVYSRF

SEQ ID NO: 72410 - protein, 23 aa, Homo sapiens
WNEDYCKLFKNITVEEMNELERQ

SEQ ID NO: 72411 - protein, 24 aa, Homo sapiens
LLAATANTSSSQLAALLQLQHQLR

SEQ ID NO: 72412 - protein, 18 aa, Homo sapiens
KLLYNLRASLNKNQSSRH

SEQ ID NO: 72413 - protein, 23 aa, Homo sapiens
EVDEMEIEINYLNQQISRHNETK

SEQ ID NO: 72414 - protein, 19 aa, Homo sapiens
KEVDEMEIEINYLNQQISR

SEQ ID NO: 72415 - protein, 20 aa, Homo sapiens
KSIENDSDEVEERAENFPRT

SEQ ID NO: 72416 - protein, 9 aa, Homo sapiens
MNETIFMKF

SEQ ID NO: 72417 - protein, 19 aa, Homo sapiens
QKENDTQIFNDSAVDNHSK

SEQ ID NO: 72418 - protein, 21 aa, Homo sapiens
RQKENDTQIFNDSAVDNHSKC

SEQ ID NO: 72419 - protein, 18 aa, Homo sapiens
SIENDSDEVEERAENFPR

SEQ ID NO: 72420 - protein, 25 aa, Homo sapiens
SSSELKKEVDEMEIEINYLNQQISR

SEQ ID NO: 72421 - protein, 18 aa, Homo sapiens
RAINMQLNNGSAGQPIRS

SEQ ID NO: 72422 - protein, 15 aa, Homo sapiens
KTGTVDNNTSTDLKS

SEQ ID NO: 72423 - protein, 28 aa, Homo sapiens
MENFSLLSISGPPISSSALSAFPDIMFS

SEQ ID NO: 72424 - protein, 21 aa, Homo sapiens
RSSNSSVSGTKKEDSTAKIHA

SEQ ID NO: 72425 - protein, 18 aa, Homo sapiens
NVLDKTRVTKDFLQDNLF

SEQ ID NO: 72426 - protein, 16 aa, Homo sapiens
RHHLMEWSPGTKEPKK

SEQ ID NO: 72427 - protein, 20 aa, Homo sapiens
KMNSSIMANVTKAFVGDSKD

SEQ ID NO: 72428 - protein, 36 aa, Homo sapiens
RHMDMLTAADRLPTQAPLSTSQSVSGKNMTASQGPC

SEQ ID NO: 72429 - protein, 34 aa, Homo sapiens
KGQIFTEANFSRECFSLQETLEAFVKEDFCMDKV

SEQ ID NO: 72430 - protein, 29 aa, Homo sapiens
RLGSTFSLDTSMSMNSSPLVGPECDHPKI

SEQ ID NO: 72431 - protein, 23 aa, Homo sapiens
AVGVGVGVGVGVPSPLNPISPLK

SEQ ID NO: 72432 - protein, 12 aa, Homo sapiens
TIFVGGVPRPLR

SEQ ID NO: 72433 - protein, 16 aa, Homo sapiens
KVDTNTENSVNTMNRS

SEQ ID NO: 72434 - protein, 21 aa, Homo sapiens
RDGGEGCSWMFQPMNNSKMRV

SEQ ID NO: 72435 - protein, 23 aa, Homo sapiens
FGLPSPDHVLGLPVGNYVQLLAK

SEQ ID NO: 72436 - protein, 12 aa, Homo sapiens
YSSGFVTADMIK

SEQ ID NO: 72437 - protein, 10 aa, Homo sapiens
QSGGASTASK

SEQ ID NO: 72438 - protein, 22 aa, Homo sapiens
RVGNLGLATSFFNEKNMNITKD

SEQ ID NO: 72439 - protein, 13 aa, Homo sapiens
RDHFMKSGFASGR

SEQ ID NO: 72440 - protein, 14 aa, Homo sapiens
DSKMAGELIKILDR

SEQ ID NO: 72441 - protein, 16 aa, Homo sapiens
KATSCMSEMQVINWRK

SEQ ID NO: 72442 - protein, 19 aa, Homo sapiens
MIEHWWNSNLTFQIYVKKT

SEQ ID NO: 72443 - protein, 13 aa, Homo sapiens
RNASNLSGAALRV

SEQ ID NO: 72444 - protein, 19 aa, Homo sapiens
AVIGSEFIGIGGNYDGTGR

SEQ ID NO: 72445 - protein, 21 aa, Homo sapiens
LACLIGVEGGHSLDSSLSVLR

SEQ ID NO: 72446 - protein, 11 aa, Homo sapiens
LALEQIDLIHR

SEQ ID NO: 72447 - protein, 18 aa, Homo sapiens
RVLEVSQAPVIFSHSAAR

SEQ ID NO: 72448 - protein, 16 aa, Homo sapiens
SFPLVDGHNDLPQVLR

SEQ ID NO: 72449 - protein, 8 aa, Homo sapiens
SFYVLGVR

SEQ ID NO: 72450 - protein, 12 aa, Homo sapiens
SWSEEELQGVLR

SEQ ID NO: 72451 - protein, 17 aa, Homo sapiens
VLEVSQAPVIFSHSAAR

SEQ ID NO: 72452 - protein, 7 aa, Homo sapiens
VVEELNR

SEQ ID NO: 72453 - protein, 7 aa, Homo sapiens
DIAAYIK

SEQ ID NO: 72454 - protein, 8 aa, Homo sapiens
DIAAYIKK

SEQ ID NO: 72455 - protein, 12 aa, Homo sapiens
DIAAYIKKEFDK

SEQ ID NO: 72456 - protein, 22 aa, Homo sapiens
NADMSEDMQQDAVDCATQAMEK

SEQ ID NO: 72457 - protein, 11 aa, Homo sapiens
KVQEHYNYTKE

SEQ ID NO: 72458 - protein, 28 aa, Homo sapiens
ADDDVFEKKQKELEAASAPEERTRLHDE

SEQ ID NO: 72459 - protein, 14 aa, Homo sapiens
AGVLLSEILHLLCK

SEQ ID NO: 72460 - protein, 13 aa, Homo sapiens
DLLDNQSQEEQRR

SEQ ID NO: 72461 - protein, 13 aa, Homo sapiens
DPAEQNGKGVALK

SEQ ID NO: 72462 - protein, 12 aa, Homo sapiens
FLKITKPTIDEK

SEQ ID NO: 72463 - protein, 13 aa, Homo sapiens
IITVSVKEDVHLK

SEQ ID NO: 72464 - protein, 17 aa, Homo sapiens
LDFIESDSPCSSEALSK

SEQ ID NO: 72465 - protein, 15 aa, Homo sapiens
LKMLTEAIMHDCVVK

SEQ ID NO: 72466 - protein, 13 aa, Homo sapiens
TTEEMLEAELELK

SEQ ID NO: 72467 - protein, 14 aa, Homo sapiens
CMTSSSPYQEFLWR

SEQ ID NO: 72468 - protein, 12 aa, Homo sapiens
LQMEPKMQSKTK

SEQ ID NO: 72469 - protein, 14 aa, Homo sapiens
ALKAAKDPDAVAVK

SEQ ID NO: 72470 - protein, 8 aa, Homo sapiens
MAKMFDLR

SEQ ID NO: 72471 - protein, 26 aa, Homo sapiens
KYDYLMTLHGVVNESTVCLMSYERRQ

SEQ ID NO: 72472 - protein, 12 aa, Homo sapiens
FGGIDLYINGIK

SEQ ID NO: 72473 - protein, 13 aa, Homo sapiens
KNLSINNDLNLRY

SEQ ID NO: 72474 - protein, 11 aa, Homo sapiens
ELTVGINGFGR

SEQ ID NO: 72475 - protein, 15 aa, Homo sapiens
GAHQNIIPASTGAAK

SEQ ID NO: 72476 - protein, 11 aa, Homo sapiens
LAQPAPYSAIK

SEQ ID NO: 72477 - protein, 19 aa, Homo sapiens
NIVSNASCTTNCLAPLAKV

SEQ ID NO: 72478 - protein, 14 aa, Homo sapiens
VPTPDVSVVDLTCR

SEQ ID NO: 72479 - protein, 37 aa, Homo sapiens
RRMESNTSSSLENLATAPVNQIQETISDNCVVIFSKT

SEQ ID NO: 72480 - protein, 17 aa, Homo sapiens
FKLDLDFPNLPYLLDGK

SEQ ID NO: 72481 - protein, 8 aa, Homo sapiens
FSWFAGEK

SEQ ID NO: 72482 - protein, 7 aa, Homo sapiens
GLAHAIR

SEQ ID NO: 72483 - protein, 12 aa, Homo sapiens
IAAYLQSDQFCK

SEQ ID NO: 72484 - protein, 9 aa, Homo sapiens
ITQSNAILR

SEQ ID NO: 72485 - protein, 14 aa, Homo sapiens
LKPQYLEELPGQLK

SEQ ID NO: 72486 - protein, 16 aa, Homo sapiens
LTFVDFLTYDILDQNR

SEQ ID NO: 72487 - protein, 12 aa, Homo sapiens
VDIIENQVMDFR

SEQ ID NO: 72488 - protein, 31 aa, Homo sapiens
REKTSLSANNATLEKQLIELTRTNELLKSKF

SEQ ID NO: 72489 - protein, 14 aa, Homo sapiens
AKIHDIVLVGGSTR

SEQ ID NO: 72490 - protein, 22 aa, Homo sapiens
GIAIGIDLGTTYSCVGVFQHGK

SEQ ID NO: 72491 - protein, 23 aa, Homo sapiens
MMRPNASQPGGAKDSVNGTMARS

SEQ ID NO: 72492 - protein, 9 aa, Homo sapiens
ACFHCETCK

SEQ ID NO: 72493 - protein, 13 aa, Homo sapiens
GFSVVADTPELQR

SEQ ID NO: 72494 - protein, 15 aa, Homo sapiens
GKGFSVVADTPELQR

SEQ ID NO: 72495 - protein, 35 aa, Homo sapiens
HIPTSAPVYQQPQQQPVAQSYGGYKEPAAPVSIQR

SEQ ID NO: 72496 - protein, 21 aa, Homo sapiens
IKKTQDQISNIKYHEEFEKSR

SEQ ID NO: 72497 - protein, 12 aa, Homo sapiens
LKQQSELQSQVR

SEQ ID NO: 72498 - protein, 14 aa, Homo sapiens
MGPSGGEGMEPERR

SEQ ID NO: 72499 - protein, 34 aa, Homo sapiens
RPLEQQQPHHIPTSAPVYQQPQQQPVAQSYGGYK

SEQ ID NO: 72500 - protein, 24 aa, Homo sapiens
YKEEFEKNKGKGFSVVADTPELQR

SEQ ID NO: 72501 - protein, 15 aa, Homo sapiens
DLADELALVDVALDK

SEQ ID NO: 72502 - protein, 13 aa, Homo sapiens
EELFLSIPCVLGR

SEQ ID NO: 72503 - protein, 17 aa, Homo sapiens
GEMMDLQHGSLFFSTSK

SEQ ID NO: 72504 - protein, 12 aa, Homo sapiens
INLNSEEEALFK

SEQ ID NO: 72505 - protein, 13 aa, Homo sapiens
INLNSEEEALFKK

SEQ ID NO: 72506 - protein, 8 aa, Homo sapiens
ISGLPVTR

SEQ ID NO: 72507 - protein, 9 aa, Homo sapiens
IVIVTAGAR

SEQ ID NO: 72508 - protein, 11 aa, Homo sapiens
KSAETLWNIQK

SEQ ID NO: 72509 - protein, 11 aa, Homo sapiens
LGTDSDKEHWK

SEQ ID NO: 72510 - protein, 11 aa, Homo sapiens
LIEDDENSQCK

SEQ ID NO: 72511 - protein, 19 aa, Homo sapiens
LKGEMMDLQHGSLFFSTSK

SEQ ID NO: 72512 - protein, 8 aa, Homo sapiens
NGVSDVVK

SEQ ID NO: 72513 - protein, 11 aa, Homo sapiens
QVIQSAYEIIK

SEQ ID NO: 72514 - protein, 10 aa, Homo sapiens
RVHPVSTMVK

SEQ ID NO: 72515 - protein, 10 aa, Homo sapiens
SAETLWNIQK

SEQ ID NO: 72516 - protein, 14 aa, Homo sapiens
SIIPAIVHYSPDCK

SEQ ID NO: 72517 - protein, 24 aa, Homo sapiens
RIVESYFMLNSTLYFSYTHMVCRT

SEQ ID NO: 72518 - protein, 27 aa, Homo sapiens
GGGEEPGKLPEPAEEESQVLRGTGHCK

SEQ ID NO: 72519 - protein, 25 aa, Homo sapiens
MNNSLDYLAYPVIVSNHRQSTTFRK

SEQ ID NO: 72520 - protein, 23 aa, Homo sapiens
MRPHEDLSEDNSSGEVVMRVTSV

SEQ ID NO: 72521 - protein, 24 aa, Homo sapiens
RGNCDSSGMNLNNISELIISNRSS

SEQ ID NO: 72522 - protein, 18 aa, Homo sapiens
RTPYRDMMLENYSLLLSV

SEQ ID NO: 72523 - protein, 11 aa, Homo sapiens
QNEGVQLLPSK

SEQ ID NO: 72524 - protein, 15 aa, Homo sapiens
TQPQVSATVVLLPDG

SEQ ID NO: 72525 - protein, 41 aa, Homo sapiens
REACANILIDSGADPNIVGVYGNTAVHYAVNSENLSVVAKL

SEQ ID NO: 72526 - protein, 16 aa, Homo sapiens
RYNVSQQALDLQNLRF

SEQ ID NO: 72527 - protein, 17 aa, Homo sapiens
DLPSIAISLCGGLSDHR

SEQ ID NO: 72528 - protein, 24 aa, Homo sapiens
GLDPSTPAQVIAPSETPSSSSVVK

SEQ ID NO: 72529 - protein, 13 aa, Homo sapiens
LCEVVDHVFPLLK

SEQ ID NO: 72530 - protein, 32 aa, Homo sapiens
RDDNMNTSEDEDMFPIEMSSDEAMELLESSRT

SEQ ID NO: 72531 - protein, 26 aa, Homo sapiens
SANQSPQSVGSSGVDSGVESTSDGLR

SEQ ID NO: 72532 - protein, 19 aa, Homo sapiens
SHSSDFPCSDTFSNFTFWR

SEQ ID NO: 72533 - protein, 16 aa, Homo sapiens
VAARRGTTAMTSAYSR

SEQ ID NO: 72534 - protein, 14 aa, Homo sapiens
VSQRTELVFGLALK

SEQ ID NO: 72535 - protein, 27 aa, Homo sapiens
AHVCNDTNKMTLINPQGAKLNIYKRKV

SEQ ID NO: 72536 - protein, 14 aa, Homo sapiens
QLHPWCSGNMVQGK

SEQ ID NO: 72537 - protein, 8 aa, Homo sapiens
YLSFPTLK

SEQ ID NO: 72538 - protein, 13 aa, Homo sapiens
RKNCSQIALFQKR

SEQ ID NO: 72539 - protein, 16 aa, Homo sapiens
RLAMAYGLNVSFLERL

SEQ ID NO: 72540 - protein, 21 aa, Homo sapiens
KWSCTEASNTSPTMSAAQNAE

SEQ ID NO: 72541 - protein, 31 aa, Homo sapiens
RRNESAAHNQAGDTSNQSSGPHSPVAAGTRG

SEQ ID NO: 72542 - protein, 19 aa, Homo sapiens
KISNVALDSMHWQNDSVQI

SEQ ID NO: 72543 - protein, 16 aa, Homo sapiens
VERPSSLLSLNTSNKG

SEQ ID NO: 72544 - protein, 24 aa, Homo sapiens
APGAAESPDLAASAELHAAPGLLR

SEQ ID NO: 72545 - protein, 33 aa, Homo sapiens
APGAAESPDLAASAELHAAPGLLRRVVVPVLVR

SEQ ID NO: 72546 - protein, 10 aa, Homo sapiens
HNPTNTIVCK

SEQ ID NO: 72547 - protein, 19 aa, Homo sapiens
KPYNPIIGETFHCSWEVPK

SEQ ID NO: 72548 - protein, 24 aa, Homo sapiens
KLCGMLTITSIFSSSNMTVIYFKS

SEQ ID NO: 72549 - protein, 26 aa, Homo sapiens
MTGVADNGSVLEITPDVAEVYLVRKN

SEQ ID NO: 72550 - protein, 25 aa, Homo sapiens
KMNNVTTDYCLDIIKKFEVSEENKV

SEQ ID NO: 72551 - protein, 13 aa, Homo sapiens
ESSMAEKEQTSNR

SEQ ID NO: 72552 - protein, 10 aa, Homo sapiens
GMPHCPGSSY

SEQ ID NO: 72553 - protein, 14 aa, Homo sapiens
IMTNLEQWAKQQKV

SEQ ID NO: 72554 - protein, 14 aa, Homo sapiens
LALAGDKIASLERS

SEQ ID NO: 72555 - protein, 9 aa, Homo sapiens
MPHCPGSSY

SEQ ID NO: 72556 - protein, 7 aa, Homo sapiens
QHQNDLK

SEQ ID NO: 72557 - protein, 11 aa, Homo sapiens
QKADTIQELQR

SEQ ID NO: 72558 - protein, 22 aa, Homo sapiens
RKTLQDNQLCMEEAMNSSHDKK

SEQ ID NO: 72559 - protein, 13 aa, Homo sapiens
NCIIVSPDAGGAK

SEQ ID NO: 72560 - protein, 27 aa, Homo sapiens
VYIVQSGCGEINDSLMELLIMINACKI

SEQ ID NO: 72561 - protein, 38 aa, Homo sapiens
RASVVWMAYMNISFHVGNHVLSELGETGVFGRSSTLKR

SEQ ID NO: 72562 - protein, 12 aa, Homo sapiens
EFQEELVDHLKK

SEQ ID NO: 72563 - protein, 27 aa, Homo sapiens
MAHSQNSLELPININATQITTAYGHRA

SEQ ID NO: 72564 - protein, 28 aa, Homo sapiens
MMMYYPGIVTCDSVTYNGSNLPAYFFKE

SEQ ID NO: 72565 - protein, 9 aa, Homo sapiens
DAAVVEVEK

SEQ ID NO: 72566 - protein, 12 aa, Homo sapiens
DGATLGTESHPR

SEQ ID NO: 72567 - protein, 19 aa, Homo sapiens
FTWNAPSPQFINGINQGYK

SEQ ID NO: 72568 - protein, 15 aa, Homo sapiens
GTQASMVCGVTHDPR

SEQ ID NO: 72569 - protein, 11 aa, Homo sapiens
ILASGSVQLPR

SEQ ID NO: 72570 - protein, 9 aa, Homo sapiens
LCAVNDVGK

SEQ ID NO: 72571 - protein, 18 aa, Homo sapiens
QLPHAPEHPVATLSTVER

SEQ ID NO: 72572 - protein, 15 aa, Homo sapiens
QVNIVGTSPPSQPSR

SEQ ID NO: 72573 - protein, 27 aa, Homo sapiens
RISWEEYNRTNTRVTHYLPNVTLEYRV

SEQ ID NO: 72574 - protein, 10 aa, Homo sapiens
TASETSLWLR

SEQ ID NO: 72575 - protein, 20 aa, Homo sapiens
VSLPEEPPTAPPQNVIASGR

SEQ ID NO: 72576 - protein, 9 aa, Homo sapiens
VSWQEPGEK

SEQ ID NO: 72577 - protein, 15 aa, Homo sapiens
ITQEPQGLGYWEAWR

SEQ ID NO: 72578 - protein, 12 aa, Homo sapiens
MYCSDLLNPNLK

SEQ ID NO: 72579 - protein, 14 aa, Homo sapiens
WCSNLTPNVPNVCR

SEQ ID NO: 72580 - protein, 24 aa, Homo sapiens
KNRSIELVQQQNVQLSLTEATEKA

SEQ ID NO: 72581 - protein, 12 aa, Homo sapiens
KYDIDPRNGIPK

SEQ ID NO: 72582 - protein, 9 aa, Homo sapiens
YPEEFSLLK

SEQ ID NO: 72583 - protein, 32 aa, Homo sapiens
ERLASSNSSQSLAPLMMEVPMLSSLGVTNSKS

SEQ ID NO: 72584 - protein, 17 aa, Homo sapiens
LGVQVVITDPEKLDQIR

SEQ ID NO: 72585 - protein, 23 aa, Homo sapiens
SLLVIPNTLAVNAAQDSTDLVAK

SEQ ID NO: 72586 - protein, 12 aa, Homo sapiens
AFHNEAQVNPER

SEQ ID NO: 72587 - protein, 18 aa, Homo sapiens
EVGDGTTSVVIIAAELLK

SEQ ID NO: 72588 - protein, 10 aa, Homo sapiens
IACLDFSLQK

SEQ ID NO: 72589 - protein, 10 aa, Homo sapiens
ICDDELILIK

SEQ ID NO: 72590 - protein, 11 aa, Homo sapiens
IHPTSVISGYR

SEQ ID NO: 72591 - protein, 12 aa, Homo sapiens
LGVQVVITDPEK

SEQ ID NO: 72592 - protein, 10 aa, Homo sapiens
LLEVEHPAAK

SEQ ID NO: 72593 - protein, 20 aa, Homo sapiens
MLVDDIGDVTITNDGATILK

SEQ ID NO: 72594 - protein, 10 aa, Homo sapiens
SLHDALCVVK

SEQ ID NO: 72595 - protein, 15 aa, Homo sapiens
SQNVMAAASIANIVK

SEQ ID NO: 72596 - protein, 29 aa, Homo sapiens
VLCELADLQDKEVGDGTTSVVIIAAELLK

SEQ ID NO: 72597 - protein, 12 aa, Homo sapiens
WIGLDLSNGKPR

SEQ ID NO: 72598 - protein, 11 aa, Homo sapiens
AGTETAILATK

SEQ ID NO: 72599 - protein, 15 aa, Homo sapiens
LEITGGGIESSVEVK

SEQ ID NO: 72600 - protein, 14 aa, Homo sapiens
LMSGILAVGPMFVR

SEQ ID NO: 72601 - protein, 32 aa, Homo sapiens
AQDGFTQWCEQMLHALNTANNLDVPTFVSFLK

SEQ ID NO: 72602 - protein, 13 aa, Homo sapiens
EEQNGEDEDGGWR

SEQ ID NO: 72603 - protein, 7 aa, Homo sapiens
NNASLSK

SEQ ID NO: 72604 - protein, 15 aa, Homo sapiens
KIMCLDEKIDNFTRQ

SEQ ID NO: 72605 - protein, 13 aa, Homo sapiens
CDNLLLDKDFNIK

SEQ ID NO: 72606 - protein, 14 aa, Homo sapiens
DLIYHMLQPDVNRR

SEQ ID NO: 72607 - protein, 10 aa, Homo sapiens
DAAVEKLRQS

SEQ ID NO: 72608 - protein, 15 aa, Homo sapiens
QIEQGLQVLATEAPR

SEQ ID NO: 72609 - protein, 23 aa, Homo sapiens
MSHFPDRGSENGTPMDVKAGVRV

SEQ ID NO: 72610 - protein, 21 aa, Homo sapiens
KNTSNKEISRDTLLTIENNPC

SEQ ID NO: 72611 - protein, 14 aa, Homo sapiens
KNCRNKSLLRSRRT

SEQ ID NO: 72612 - protein, 34 aa, Homo sapiens
KRPETKLKPLPVAPSQPTLGSSNINGSIDYPAKN

SEQ ID NO: 72613 - protein, 14 aa, Homo sapiens
KDFLNVTTEANILP

SEQ ID NO: 72614 - protein, 14 aa, Homo sapiens
EKPLALYMFSSNDK

SEQ ID NO: 72615 - protein, 19 aa, Homo sapiens
LIQEQEQELVGALAADLHK

SEQ ID NO: 72616 - protein, 18 aa, Homo sapiens
APEPLELTLPVELLADTR

SEQ ID NO: 72617 - protein, 15 aa, Homo sapiens
RSDDNLLNTSALGRL

SEQ ID NO: 72618 - protein, 14 aa, Homo sapiens
FPLTNAIKDALAAT

SEQ ID NO: 72619 - protein, 22 aa, Homo sapiens
GQEDASPDRFSNTDYAVGYMLR

SEQ ID NO: 72620 - protein, 26 aa, Homo sapiens
SFTLASSETGVGAPISGPGIPGRFTK

SEQ ID NO: 72621 - protein, 16 aa, Homo sapiens
THGFDGLDLAWLYPGR

SEQ ID NO: 72622 - protein, 14 aa, Homo sapiens
TLLSVGGWNFGSQR

SEQ ID NO: 72623 - protein, 11 aa, Homo sapiens
VTIDSSYDIAK

SEQ ID NO: 72624 - protein, 19 aa, Homo sapiens
RVVLLDPKPVANVTCVNKH

SEQ ID NO: 72625 - protein, 13 aa, Homo sapiens
SEQLGGDVESYDK

SEQ ID NO: 72626 - protein, 17 aa, Homo sapiens
DLSMIVLLPNEIDGLQK

SEQ ID NO: 72627 - protein, 19 aa, Homo sapiens
FYQTSVESTDFANAPEESR

SEQ ID NO: 72628 - protein, 11 aa, Homo sapiens
LMEWTSLQNMR

SEQ ID NO: 72629 - protein, 16 aa, Homo sapiens
QYNSFNFALLEDVQAK

SEQ ID NO: 72630 - protein, 27 aa, Homo sapiens
TMGMVNIFNGDADLSGMTWSHGLSVSK

SEQ ID NO: 72631 - protein, 14 aa, Homo sapiens
VLHFDQVTENTTEK

SEQ ID NO: 72632 - protein, 19 aa, Homo sapiens
VLHFDQVTENTTEKAATYH

SEQ ID NO: 72633 - protein, 8 aa, Homo sapiens
ENEALKDK

SEQ ID NO: 72634 - protein, 9 aa, Homo sapiens
EYKCDVLMR

SEQ ID NO: 72635 - protein, 13 aa, Homo sapiens
IEHICTSDNWMDR

SEQ ID NO: 72636 - protein, 7 aa, Homo sapiens
MVEPIGN

SEQ ID NO: 72637 - protein, 11 aa, Homo sapiens
NAYVWVQNPLK

SEQ ID NO: 72638 - protein, 14 aa, Homo sapiens
NAYVWVQNPLKVLK

SEQ ID NO: 72639 - protein, 7 aa, Homo sapiens
NSYTESR

SEQ ID NO: 72640 - protein, 8 aa, Homo sapiens
QHYLSPSR

SEQ ID NO: 72641 - protein, 22 aa, Homo sapiens
SFNYIEFHCSMDGYVDSIEDLK

SEQ ID NO: 72642 - protein, 16 aa, Homo sapiens
HAVSEGTKAVTKYTSA

SEQ ID NO: 72643 - protein, 17 aa, Homo sapiens
HAVSEGTKAVTKYTSAK

SEQ ID NO: 72644 - protein, 10 aa, Homo sapiens
KESYSVYVYK

SEQ ID NO: 72645 - protein, 12 aa, Homo sapiens
SRKESYSVYVYK

SEQ ID NO: 72646 - protein, 15 aa, Homo sapiens
PDPAKSAPAPKKGSK

SEQ ID NO: 72647 - protein, 25 aa, Homo sapiens
DDVSSFVDPGLALQDAQDLYAAGEK

SEQ ID NO: 72648 - protein, 25 aa, Homo sapiens
KYWAAEKVQEGVRNISNQLSITTKI

SEQ ID NO: 72649 - protein, 11 aa, Homo sapiens
IIATSQGLLIR

SEQ ID NO: 72650 - protein, 19 aa, Homo sapiens
KQQLYVSSNEGVSQVSLHR

SEQ ID NO: 72651 - protein, 25 aa, Homo sapiens
KVVVLPTNNSVSGELILEELEVFKN

SEQ ID NO: 72652 - protein, 30 aa, Homo sapiens
LVCSVTDEDGPETHFDELEDVFLLETDNPR

SEQ ID NO: 72653 - protein, 11 aa, Homo sapiens
NAAEIVQYGVK

SEQ ID NO: 72654 - protein, 9 aa, Homo sapiens
NHAPITTMK

SEQ ID NO: 72655 - protein, 14 aa, Homo sapiens
NHPLMYNSIYPIHK

SEQ ID NO: 72656 - protein, 20 aa, Homo sapiens
SVQGSDQGLYHCIATENSFK

SEQ ID NO: 72657 - protein, 9 aa, Homo sapiens
VYLTFDELR

SEQ ID NO: 72658 - protein, 10 aa, Homo sapiens
YHVLFLGTDR

SEQ ID NO: 72659 - protein, 21 aa, Homo sapiens
RANNSDFGLVAAVFTNDINKA

SEQ ID NO: 72660 - protein, 10 aa, Homo sapiens
GLGGLIVVSK

SEQ ID NO: 72661 - protein, 16 aa, Homo sapiens
LHFGIDPDDTTITDLP

SEQ ID NO: 72662 - protein, 10 aa, Homo sapiens
LTLFHIEQGK

SEQ ID NO: 72663 - protein, 31 aa, Homo sapiens
VGDSPCLGAGGYADNDIGAVSTTGHGESILK

SEQ ID NO: 72664 - protein, 12 aa, Homo sapiens
WTSTSMPWAAAK

SEQ ID NO: 72665 - protein, 29 aa, Homo sapiens
KMADALLFGNFGVQNITAAIQLYESLAKE

SEQ ID NO: 72666 - protein, 24 aa, Homo sapiens
FDCSSAPDICSNLYVFQPSLAVFK

SEQ ID NO: 72667 - protein, 13 aa, Homo sapiens
TTLGPQNFPANDK

SEQ ID NO: 72668 - protein, 12 aa, Homo sapiens
VDCQAYAQTCQK

SEQ ID NO: 72669 - protein, 20 aa, Homo sapiens
QISQEHTPVALEAYFVPLVK

SEQ ID NO: 72670 - protein, 26 aa, Homo sapiens
AFQTVVLDPEGDAQIDPNWVVLNQGR

SEQ ID NO: 72671 - protein, 20 aa, Homo sapiens
DGIGDACDPDADGDGVPNEK

SEQ ID NO: 72672 - protein, 15 aa, Homo sapiens
DGVGDVCQDDFDADK

SEQ ID NO: 72673 - protein, 11 aa, Homo sapiens
DTDLDGFPDEK

SEQ ID NO: 72674 - protein, 13 aa, Homo sapiens
ELQETNAALQDVR

SEQ ID NO: 72675 - protein, 20 aa, Homo sapiens
FYEGPELVADSNVVLDTTMR

SEQ ID NO: 72676 - protein, 24 aa, Homo sapiens
GPCPAGFTGNGSHCTDVNECNAHP

SEQ ID NO: 72677 - protein, 22 aa, Homo sapiens
GSFQCGPCQPGFVGDQASGCQR

SEQ ID NO: 72678 - protein, 16 aa, Homo sapiens
IDVCPENAEVTLTDFR

SEQ ID NO: 72679 - protein, 17 aa, Homo sapiens
KDNCVTVPNSGQEDVDR

SEQ ID NO: 72680 - protein, 14 aa, Homo sapiens
NALWHTGDTESQVR

SEQ ID NO: 72681 - protein, 10 aa, Homo sapiens
PEDYETHQLR

SEQ ID NO: 72682 - protein, 13 aa, Homo sapiens
QMEQTYWQANPFR

SEQ ID NO: 72683 - protein, 26 aa, Homo sapiens
QVCTDINECETGQHNCVPNSVCINTR

SEQ ID NO: 72684 - protein, 31 aa, Homo sapiens
RCGPCPAGFTGNGSHCTDVNECNAHPCFPRV

SEQ ID NO: 72685 - protein, 19 aa, Homo sapiens
RYRCNDTIPEDYETHQLRQ

SEQ ID NO: 72686 - protein, 10 aa, Homo sapiens
SSTGPGEQLR

SEQ ID NO: 72687 - protein, 12 aa, Homo sapiens
TIPEDYETHQLR

SEQ ID NO: 72688 - protein, 17 aa, Homo sapiens
YRCNDTIPEDYETHQLR

SEQ ID NO: 72689 - protein, 13 aa, Homo sapiens
VVNSTTGPGEHLR
